US012605442B2

(12) United States Patent
Goodrich et al.

(10) Patent No.: US 12,605,442 B2
(45) Date of Patent: Apr. 21, 2026

(54) PRODUCTION OF VACCINES COMPRISING INACTIVATED SARS-CoV-2 VIRAL PARTICLES

(71) Applicants: Colorado State University Research Foundation, Fort Collins, CO (US); Dynavax Technologies Corporation, Emeryville, CA (US)

(72) Inventors: Raymond P. Goodrich, Fort Collins, CO (US); Richard Bowen, Fort Collins, CO (US)

(73) Assignees: Colorado State University Research Foundation, Fort Collins, CO (US); Dynavax Technologies Corporation, Emeryville, CA (US)

( * ) Notice: Subject to any disclaimer, the term of this patent is extended or adjusted under 35 U.S.C. 154(b) by 791 days.

(21) Appl. No.: 17/905,700

(22) PCT Filed: Mar. 5, 2021

(86) PCT No.: PCT/US2021/021190
§ 371 (c)(1),
(2) Date: Sep. 6, 2022

(87) PCT Pub. No.: WO2021/178877
PCT Pub. Date: Sep. 10, 2021

(65) Prior Publication Data
US 2023/0346915 A1 Nov. 2, 2023

Related U.S. Application Data

(60) Provisional application No. 63/079,278, filed on Sep. 16, 2020, provisional application No. 63/079,251, filed on Sep. 16, 2020, provisional application No. 63/055,041, filed on Jul. 22, 2020, provisional application No. 63/039,786, filed on Jun. 16, 2020, provisional application No. 62/986,160, filed on Mar. 6, 2020.

(51) Int. Cl.
| | |
|---|---|
| *A61K 39/215* | (2006.01) |
| *A61K 39/00* | (2006.01) |
| *A61K 39/39* | (2006.01) |
| *A61P 31/14* | (2006.01) |

(52) U.S. Cl.
CPC ............ *A61K 39/215* (2013.01); *A61K 39/39* (2013.01); *A61P 31/14* (2018.01); *A61K 2039/5252* (2013.01); *A61K 2039/55561* (2013.01); *A61K 2039/55566* (2013.01)

(58) Field of Classification Search
CPC .................. A61K 39/215; A61K 39/39; A61K 2039/5252; A61K 2039/55561; A61K 2039/55566; A61K 2039/525; A61K 2039/5254; A61K 2039/54; A61K 2039/543; A61K 39/12; A61P 31/14; Y02A 50/30; A61M 2202/206; C12N 2770/20034
See application file for complete search history.

(56) References Cited

U.S. PATENT DOCUMENTS

| | | | |
|---|---|---|---|
| 6,309,650 B1 | 10/2001 | Kim et al. | |
| 6,589,940 B1 | 7/2003 | Raz et al. | |
| 7,186,543 B1 * | 3/2007 | Goodrich ...................... | 435/236 |
| 10,953,089 B1 | 3/2021 | Smith et al. | |
| 11,213,482 B1 | 1/2022 | Gambotto et al. | |
| 11,684,669 B2 | 6/2023 | Meinke et al. | |
| 2006/0257852 A1 | 11/2006 | Rappuoli et al. | |
| 2007/0116716 A1 | 5/2007 | Shen et al. | |
| 2009/0017069 A1 | 1/2009 | Akeefe et al. | |
| 2009/0104229 A1 | 4/2009 | Voss | |
| 2010/0303851 A1 * | 12/2010 | Hoerr et al. ............... | 424/193.1 |
| 2011/0052621 A1 | 3/2011 | Champion et al. | |
| 2017/0246281 A1 | 8/2017 | Super et al. | |
| 2019/0134190 A1 | 5/2019 | Rittner et al. | |
| 2021/0260181 A1 | 8/2021 | Georges et al. | |
| 2021/0308257 A1 | 10/2021 | Kuo et al. | |
| 2023/0038284 A1 | 2/2023 | Meinke et al. | |
| 2023/0092650 A1 | 3/2023 | Campbell et al. | |
| 2023/0110516 A1 | 4/2023 | Campbell et al. | |
| 2023/0218740 A1 | 7/2023 | Campbell et al. | |

FOREIGN PATENT DOCUMENTS

| | | |
|---|---|---|
| CN | 1827936 A | 9/2006 |
| CN | 101240271 A | 8/2008 |
| CN | 102068692 A | 5/2011 |

(Continued)

OTHER PUBLICATIONS

Lee et al., "Recent Advances of Vaccine Adjuvants for Infectious Diseases", A Review Article—Immune Network, Apr. 2015, vol. 15 , No. 2, pp. 51-57. (Year: 2015).*

(Continued)

*Primary Examiner* — Satyendra K Singh
(74) *Attorney, Agent, or Firm* — Berg Hill Greenleaf Ruscitti LLP

(57) ABSTRACT

Provided herein are methods for inactivating a viral particle, the methods comprising contacting the viral particle with UV light in the presence of riboflavin. In some embodiments, the viral particle is a SARS-CoV-2 particle. Vaccine compositions comprising inactivated viral particles (e.g., inactivated SARS-CoV-2 particles) are also provided. In some embodiments, the vaccine compositions comprise an adjuvant capable of promoting a Th1-type immune response.

12 Claims, 55 Drawing Sheets
Specification includes a Sequence Listing.

(56) References Cited

FOREIGN PATENT DOCUMENTS

| EP | 2484378 A1 | 8/2012 |
|----|------------|--------|
| WO | 2000020039 A1 | 4/2000 |
| WO | 2000062802 A2 | 10/2000 |
| WO | 2000062802 A3 | 1/2001 |
| WO | 2001000232 A2 | 1/2001 |
| WO | 2001000232 A3 | 5/2001 |
| WO | 2003011334 A1 | 2/2003 |
| WO | 2004092360 A2 | 10/2004 |
| WO | 2004094614 A2 | 11/2004 |
| WO | 2004092360 A3 | 8/2005 |
| WO | 2005111238 A2 | 11/2005 |
| WO | 2005111238 A3 | 5/2006 |
| WO | 2004094614 A3 | 7/2006 |
| WO | 2007122392 A1 | 11/2007 |
| WO | 2013083726 A1 | 6/2013 |
| WO | 2014153087 A1 | 9/2014 |
| WO | 2016203025 A1 | 12/2016 |
| WO | 2017109223 A1 | 6/2017 |
| WO | 2017109225 A1 | 6/2017 |
| WO | 2018147265 A1 | 8/2018 |
| WO | 2018200645 A1 | 11/2018 |
| WO | 2019057793 A1 | 3/2019 |
| WO | 2021048221 A1 | 3/2021 |
| WO | 2021176434 A1 | 9/2021 |
| WO | 2021178306 A1 | 9/2021 |
| WO | 2021178318 A1 | 9/2021 |
| WO | 2021178321 A1 | 9/2021 |
| WO | 2021204825 A2 | 10/2021 |
| WO | 2021254473 A1 | 12/2021 |

OTHER PUBLICATIONS

Chang Le et al: Coronavirus Disease 2019: Coronaviruses and Blood Safety11 , Transfusion Medi Ci Ne Reviews, Grune and Stratton, Orlando, FL, US, vol. 34, No. 2, Feb. 21, 2020 (Feb. 21, 2020), pp. 75-80, XP086176615,ISSN: 0887-7963, DOI: 10.1016/J.TMRV.2020.02.003 [retrieved on Feb. 21, 2020] p. 78, left-hand column, paragraph 1.

Keil Shawn D et al: "Inactivation of Middle East respiratory syndrome coronavirus (MERS-CoV) in plasma products using a riboflavin-based and ultraviolet light-based photochemical treatment : Riboflavin and Light Reduce MERS-CoV", Transfusion, vol. 56, No. 12, Dec. 1, 2016 (Dec. 1, 2016), pp. 2948-2952, XP055812464, US ISSN: 0041-1132, DOI: 10.1111/trf.13860 p. 2949, right-hand column, paragraph 1.

Callahan et al: "Controlled inactivation of recombinant viruses with vitamin B"2", Journal of Virological Methods, Elsevier BV, NL, vol. 148, No. 1-2, Dec. 21, 2007 (Dec. 21, 2007), pp. 132-145, XP022487603, ISSN: 0166-0934, DOI:10.1016/J.ICA.2007.06.046page 134, left-hand column, paragraph 1.

Ragan I Zabela et al: "Pathogen reduction of SARS-CoV-2 virus in plasma and whole blood using riboflavin and UV light", PLOS ONE, vol. 15, No. 5, May 29, 2020 (May 29, 2020), p. e0233947, XP055812473, DOI: 10.1371/journal.pone.0233947 Retrieved from the Internet: URL:https://www.ncbi.nlm.nih.gov/pmc/artic les/PMC7259667/pdf/pone.0233947.pdf.tables 2,4.

Ruane Patrick H. et al: "Photochemical inactivation of selected viruses and bacteria in platelet concentrates using riboflavin and light : Reduction of Selected Pathogens in PLTs", TRANSFUSION, vol. 44, No. 6, Jun. 1, 2004 (Jun. 1, 2004), pp. 877-885, XP055812806, US ISSN: 0041-1132, DOI: 10.1111/i.1537-2995.2004.03355.x the whole document.

International Search Report and Written Opinion with a mailing date of Aug. 18, 2021 in International Application No. PCT/US2021/021190, 16 pages.

Ng, M.-L. et al. (Dec. 2003). "Proliferative Growth of SARS Coronavirus in Vero E6 Cells," J. Gen. Virol. 84(12):3291-3303.

Ou, X. et al. (Mar. 27, 2020). "Characterization of Spike Glycoprotein of SARS-CoV-2 on Virus Entry and Its Immune Cross-Reactivity With SARS-CoV," Nat. Commun. 11(1):1620.

Pearson, W.R. et al. (Apr. 1988). "Improved Tools For Biological Sequence Comparison," Proc. Natl. Acad. Sci. USA 85(8):2444-2448.

Petrovsky, N. (Dec. 31, 2016). "SARS Coronavirus Infections of the Lower Respiratory Tract and Their Prevention," Chapter 3—The Microbiology of Respiratory System Infections, pp. 45-53.

Pramanick, S. et al. (Mar. 2013). "Excipient Selection In Parenteral Formulation Development," Pharma Times 45(3):65-77.

Rabaan, A.A. et al. (Apr. 7, 2020). "SARS-CoV-2/COVID-19 and Advances in Developing Potential Therapeutics and Vaccines to Counter This Emerging Pandemic," 19:40, 37 pages.

Ragan, I.K. et al. (2021, e-pub. Apr. 1, 2021). "A Whole Virion Vaccine for COVID-19 Produced via a Novel Inactivation Method and Preliminary Demonstration of Efficacy in an Animal Challenge Model," Vaccines, 9:340, 24 pages.

Rauch, S. et al. (2018, e-pub. Sep. 19, 2018). "New Vaccine Technologies to Combat Outbreak Situations," Front. Immunol. 9:1963, 38 pages.

Richmond, P. et al. (Feb. 20, 2021, e-pub. Jan. 29, 2021). "Safety and Immunogenicity of S-Trimer (SCB-2019), A Protein Subunit Vaccine Candidate for COVID-19 in Healthy Adults: A Phase 1, Randomised, Double-Blind, Placebo-Controlled Trial," Lancet 397:682-694.

Roberts, A. et al. (Apr. 2008, e-pub. May 11, 2007). "Animal Models and Vaccines for SARS-CoV Infection," Virus Res. 133(1):20-32.

Roberts, A. et al. (May 2005). "Aged BALB/c Mice as a Model for Increased Severity of Severe Acute Respiratory Syndrome in Elderly Humans," J. Virol. 79(9):5833-5838.

Sah, R. et al. (Mar. 12, 2020). "Complete Genome Sequence of a 2019 Novel Coronavirus (SARS-CoV-2) Strain Isolated in Nepal," Microbiol. Resour. Announc. 9(11):e00169-20, 3 pages.

Schlegl, R. et al. (Nov. 4, 2015, e-pub. Jun. 19, 2015). "Influence of Elemental Impurities in Aluminum Hydroxide Adjuvant on The Stability of Inactivated Japanese Encephalitis Vaccine, IXIARO®," Vaccine. 33(44):5989-5996.

See, R.H. et al. (Sep. 2008). "Severe Acute Respiratory Syndrome Vaccine Efficacy in Ferrets: Whole Killed Virus and Adenovirus-Vectored Vaccines," J Gen Virol. 89(Pt 9):2136-2146.

Sekimukai, H. et al. (Jan. 2020, e-pub. Nov. 2019). "Gold Nanoparticle-Adjuvanted S Protein Induces a Strong Antigen-Specific IgG Response Against Severe Acute Respiratory Syndrome-Related Coronavirus Infection, But Fails to Induce Protective Antibodies and Limit Eosinophilic Infiltration in Lungs," Microbiol. Immunol. 64(1):33-51.

Shah, R.R. et al. (2017). "Chapter 1: Overview of Vaccine Adjuvants: Introduction, History, and Current Status," Methods Mol. Biol. 1494:1-13.

Shang, J. et al. (May 14, 2020, e-pub. Mar. 30, 2020). "Structural Basis of Receptor Recognition by SARS-CoV-2," Nature. 581(7807):221-224, 18 pages.

Shang, W. et al. (Mar. 6, 2020). "The Outbreak of SARS-CoV-2 Pneumonia Calls for Viral Vaccines," NPJ Vaccines 5(1):18, 3 pages.

Shanmugaraj, B. et al. (Feb. 22, 2020). "Emergence of Novel Coronavirus 2019-nCoV: Need for Rapid Vaccine and Biologics Development," Pathogens 9(2):148, 10 pages.

She, Y.-M. et al. (Dec. 2013). "Surface Modifications of Influenza Proteins Upon Virus Inactivation by β-propiolactone," Proteomics 13(23-24):3537-3547.

Shi, Y. et al. (May 2020, e-pub. Mar. 23, 2020). "COVID-19 Infection: The Perspectives on Immune Responses," Cell Death Differ. 27(5):1451-1454.

Spruth, M. et al. (Jan. 30, 2006, e-pub. Aug. 26, 2005). "A Double-Inactivated Whole Virus Candidate SARS Coronavirus Vaccine Stimulates Neutralising and Protective Antibody Responses," Vaccine 24(5):652-661.

Srivastava, A.K. et al. (Aug. 14, 2001). "A Purified Inactivated Japanese Encephalitis Virus Vaccine Made In Vero Cells," Vaccine 19(31):4557-4565.

Subbarao, K. et al. (Apr. 2004). "Prior Infection and Passive Transfer of Neutralizing Antibody Prevent Replication of Severe

(56) References Cited

OTHER PUBLICATIONS

Acute Respiratory Syndrome Corona Virus in the Respiratory Tract of Mice," J. Virol. 78(7):3572-3577.

Szurgot, I. et al. (Feb. 4, 2021). "DNA-Launched RNA Replicon Vaccines Induce Potent Anti-SARS-CoV-2 Immune Responses in Mice," Sci. Rep. 11(1):3125, 13 pages.

Tetro, J.A. (Mar. 2020, e-pub. Feb. 22, 2020). Is COVID-19 Receiving ADE From Other Coronaviruses? Microbes Infect. 22(2):72-73.

Thomas, L.J. et al. (Feb. 2009, e-pub. Feb. 1, 2009). "Co-Administration of a CpG Adjuvant (VaxImmune, CPG 7909) With CETP vaccines Increased Immunogenicity in Rabbits and Mice," Hum Vaccin. 5(2):79-84.

Tian, X. et al. (2020, e-pub. Feb. 17, 2020). "Potent Binding of 2019 Novel Coronavirus Spike Protein by a SARS Coronavirus-Specific Human Monoclonal Antibody," Emerg. Microbes Infect. 9(1):382-385.

Tian, Y. et al. (Apr. 28, 2017). "The Novel Complex Combination of Alum, CpG ODN and HH2 as Adjuvant in Cancer Vaccine Effectively Suppresses Tumor Growth in vivo," Oncotarget. 8(28):45951-45964.

Tseng, C.-T. et al. (2012, e-pub. Apr. 20, 2012). "Immunization with SARS Coronavirus Vaccines Leads to Pulmonary Immunopathology on Challenge with the SARS Virus," PloS ONE, 7(4):e35421, 13 pages.

Tseng, C.-T.K. et al. (Feb. 2007, e-pub. Nov. 15, 2006). "Severe Acute Respiratory Syndrome Coronavirus Infection of Mice Transgenic for the Human Angiotensin-Converting Enzyme 2 Virus Receptor," J Virol. 81(3):1162-1173.

Uittenbogaard, J.P. et al. (Oct. 21, 2011, e-pub. Aug. 25, 2011). "Reactions of Beta-Propiolactone With Nucleobase Analogues, Nucleosides, and Peptides: Implications for the Inactivation of Viruses," J. Biol. Chem. 286(42):36198-36214.

Walls, A. C. et al. (Apr. 16, 2020). "Structure, Function, and Antigenicity of the SARS-CoV-2 Spike Glycoprotein," Cell 180(2):281-292, 38 pages.

Wan, Y. et al. (Mar. 2020, e-pub. Feb. 14, 2020). "Molecular Mechanism for Antibody-Dependent Enhancement of Coronavirus Entry," J. Virol. 94(5):e02015-19, 15 pages.

Wang, B. et al. (2020). "The Potential for Antibody-Dependent Enhancement of SARS-CoV-2 Infection: Transnational Implications for Vaccine Development," Journal of Clinical and Translational Science 5:e2, 4 pages.

Wang, S.-F. et al. (Aug. 22, 2014, e-pub. Jul. 26, 2014). "Antibody-Dependent SARS Coronavirus Infection is Mediated by Antibodies Against Spike Proteins," Biochem. Biophys. Res. Commun. 451(2):208-214.

Wang, Z.-B. et al. (Mar. 13, 2020). "Better Adjuvants for Better Vaccines: Progress in Adjuvant Delivery Systems, Modifications, and Adjuvant-Antigen Codelivery," Vaccines (Basel). 8(1):128, 20 pages.

Weissman, D. et al. (Jan. 13, 2021). "D614G Spike Mutation Increase SARS CoV-2 Susceptibility to Neutralization," Cell Host of Microb. 29:23-31.

Wrapp, D. et al. (Mar. 13, 2020, e-pub. Feb. 19, 2020). "Cryo-EM Structure of the 2019-nCoV Spiked in the Prefusion Conformation," Science 367:1260-1263.

Wu, F. et al. (Mar. 2020, e-pub Feb. 3, 2020). "A New Coronavirus Associated with Human Respiratory Disease in China," Nature 579(7798):265-269, 20 pages.

Wu, Z. et al. (Apr. 7, 2020). "Characteristics of and Important Lessons From the Coronavirus Disease 2019 (COVID-19) Outbreak in China: Summary of a Report of 72 314 Cases From The Chinese Center for Disease Control and Prevention," JAMA. 323(13):1239-1242.

Xiong, X. et al. (Oct. 1, 2020). "A Thermostable, Closed SARS-CoV-2 Spike Protein Trimer," Nat. Struct. Mol. Biol. 27(10):934-941, 27 pages.

Zakhartchouk, A.N. et al. (2007, e-pub. Aug. 2, 2008). "Immunogenicity of a Receptor-Binding Domain of SARS Coronavirus Spike Protein in Mice: Implications for a Subunit Vaccine," Vaccine 25:136-143.

Zeng, W. et al. (Jun. 30, 2020, e-pub. Apr. 30, 2020). "Biochemical Characterization of SARS-CoV-2 Nucleocapsid Protein," Biochem. Biophys. Res. Commun. 527(3):618-623.

Zhang, B.-Z. et al. (Aug. 2020, e-pub. Jul. 1, 2020). "Mining of Epitopes on Spike Protein of SARS-CoV-2 From COVID-19 Patients," Cell Res. 30(8):702-704.

Zhang, J. et al. (2020). "Progress and Prospects on Vaccine Development Against SARS-CoV-2," Vaccines 8:153, 12 pages.

Zhao, K. et al. (2011, e-pub. Jul. 13, 2011). "The Immune Responses of HLA-A*0201 Restricted SARS-CoV S Peptide-Specific CD8+ T Cells are Augmented in Varying Degrees by CpGODN, Polyl:C and R848," Vaccine 29:6670-6678.

Zhou, P. et al. (Mar. 12, 2020, e-pub. Feb. 3, 2020). "A Pneumonia Outbreak Associated With a New Coronavirus of Probable Bat Origin," Nature, 579:270-273, 20 pages.

Zhu, N. et al. (Feb. 20, 2020, e-pub. Jan. 24, 2020). "A Novel Coronavirus From Patients With Pneumonia in China 2019," N Engl. J. Med. 382(8):727-733.

Abdullah, S.F. et al. (2020, e-pub. Jun. 30, 2020). "SARS-CoV-2: A Piece of Bad News," Medeniyet Med. J. 35(2):151-160.

Afrough, B. et al. (May 2019). "Emerging Viruses and Current Strategies for Vaccine Intervention," Clin Exp. Immunol. 196(2):157-166.

Agrawal, A.S. et al. (2016, e-pub. Jun. 7, 2016). "Immunization with Inactivated Middle East Respiratory Syndrome Coronavirus Vaccine Leads to Lung Immunopathology on Challenge with Live Virus," Human Vaccines & Immunotherapeutics 12(9):2351-2356.

Ahmed, S.F. et al. (Mar. 2020, e-pub. Feb. 25, 2020). "Preliminary Identification of Potential Vaccine Targets for the COVID-19 Coronavirus (SARS-CoV-2) Based on SARS-CoV Immunological Studies," Viruses 12(3):254, 15 pages.

Amanat, F. et al. (Jul. 16, 2020). "A Serological Assay to Detect SARS-CoV-2 Seroconversion in Humans," MedRxiv, Jan. 26, 2012.

Anonymous (2021). "What's in Vaccines?," The Center for Disease Control and Prevention, 2 pages.

Anonymous (Jan. 30, 2020). "Novel Coronavirus (2019-nCOV), Situation Report 10," World Health Organization, 7 pages.

Anonymous (Jun. 24, 2022). "Valneva Receives Marketing Authorization in Europe for Inactivated Whole-Virus COVID-19 Vaccine VLA2001," Valneva Press Release, 4 pages.

Arunachalam, P.S. et al. (Jun. 10, 2021, e-pub. Apr. 19, 2021). "Adjuvanting a Subunit COVID-19 Vaccine to Induce Protective Immunity," Nature 594:253-258, 27 pages.

Bao, L. et al. (Mar. 4, 2020), "Reinfection Could Not Occur in SARS-Co V-2 Infected Rhesus Macaques," BioRxiv, 20 pages.

Bao, M. et al. (2006, e-pub. Nov. 17, 2005). "Anti-SARS-CoV Immunity Induced by a Novel CpG Oligodeoxynucleotide," Clinical Immunology 118:180-187.

Berger, A. (Aug. 12, 2000). Th1 and Th2 Responses: What Are They? BMJ. 321(7258):424, 1 page.

Bode, C. et al. (Apr. 2011, e-pub. Apr. 1, 2012). "CpG DNA as a Vaccine Adjuvant," Expert Rev Vaccines 10(4):499-511, 22 pages.

Braun, R.P. et al. (Sep. 15, 1988). "Immunogenic Duplex Nucleic Acids are Nuclease Resistant," J Immunol. 141(6):2084-2089.

Callaway, E. (Apr. 2020). "The Race for Coronavirus Vaccines: A Graphical Guide," Nature 580(7805):576-577.

Campbell, J.D. (2017). "Chapter 2: Development of The CpG Adjuvant 1018: A Case Study," Methods Mol Biol. 1494:15-27.

Capobianchi, M.R. et al. (Jul. 2020, e-pub. Mar. 27, 2020). "Molecular Characterization of SARS-CoV-2 From the First Case of COVID-19 in Italy," Clin. Microbial Infect. 26(7):954-956.

Chan, J.F.-W. et al. (2020, e-pub. Jan. 28, 2020). "Genomic Characterization of the 2019 Novel Human-Pathogenic Coronavirus Isolated From a Patient With Atypical Pneumonia After Visiting Wuhan," Emerging Microbes & Infections 9(1):221-236.

Chen, Y. et al. (2020, e-pub. Feb. 17, 2020). "Structure Analysis of the Receptor Binding of 2019-nCOV," Biochemical and Biophysical Research Communications 525:135-140.

(56)　　　　　References Cited

OTHER PUBLICATIONS

Chuang, T.-H. et al. (Mar. 2002). "Toll-Like Receptor 9 Mediates CpG-DNA Signaling," J Leukoc Biol. 71(3):538-544.

Coffman, R.L. et al. (Oct. 29, 2010, e-pub. Aug. 16, 2012). "Vaccine Adjuvants: Putting Innate Immunity to Work," Immunity 33(4):492-503, 21 pages.

Darnell, M.E.R. et al. (Oct. 2004, e-pub. Aug. 3, 2004). "Inactivation of The Coronavirus That Induces Severe Acute Respiratory Syndrome, SARS-CoV," J. Virol. Methods 121(1):85-91.

Deng, Y. et al. (Dec. 1, 2018, e-pub. Apr. 4, 2018). "Enhanced Protection in Mice Induced by Immunization With Inactivated Whole Viruses Compare to Spike Protein of Middle East Respiratory Syndrome Coronavirus," Emerging Microbes & Infections 7(1):60, 11 pages.

Devereux, J. et al. (1984). "A Comprehensive Set of Sequence Analysis Programs for the VAX," Nucleic Acids Research 12(1):387-395.

Draper, S.J. et al. (Jul. 11, 2018). "Malaria Vaccines: Recent Advances and New Horizons," Cell Host Microbe 24(1):43-56.

Du, L. et al. (Mar. 2009, e-pub. Feb. 9, 2009). "The Spike Protein of SARS-CoV—a Target for Vaccine and Therapeutic Development," Nature Reviews Microbiology, 7:226-236.

Enjuanes, L. et al. (Mar. 2015, e-pub. Aug. 30, 2016). "Molecular Basis of Coronavirus Virulence and Vaccine Development," Adv. Virus Res. 96:245-286, 31 pages.

Excler, J.-L. et al. (Apr. 2021, e-pub. Apr. 12, 2021). "Vaccine Development for Emerging Infectious Diseases," Nat Med. 27(4):591-600.

Extended European Search Report, dated Sep. 22, 2021, for European Patent Application No. 21167076.5, 6 pages.

Ferguson, N.M. et al. (Mar. 16, 2020). "Report 9: Impact of Non-Pharmaceutical Interventions (NPIs) to Reduce COVID-19 Mortality and Healthcare Demand," Imperial College London, 20 pages.

Francica, J.R. et al. (Nov. 28, 2017). "Innate Transcriptional Effects by Adjuvants on the Magnitude, Quality and Durability of HIV Envelope Responses in NHPs," Blood Adv. 1(25):2329-2342.

Frieman, M. et al. (Jan. 2012, e-pub. Nov. 9, 2011). "Molecular Determinants of Severe Acute Respiratory Syndrome Coronavirus Pathogenesis and Virulence in Young and Aged Mouse Models of Human Disease," J. Virol. 86(2):884-897.

Gao, Q. et al. (Jul. 3, 2020, e-pub. May 6, 2020). "Development of an Inactivated Vaccine Candidate for SARS-CoV-2," Science 369(6499):77-81, 5 pages.

GENBANK Submission; NIH/NCBI, Accession No. MN908947.3. Wu et al., Mar. 18, 2020, 11 pages.

GENBANK Submission; NIH/NCBI, Accession No. MT066156.1 Capobianchi et al., Apr. 13, 2020, 11 pages.

Glass, W.G. et al. (Sep. 15, 2004). "Mechanisms of Host Defense Following Severe Acute Respiratory Syndrome-Coronavirus (SARS-CoV) Pulmonary Infection of Mice," J. Immunol. 173(6):4030-4039.

Graham, B.S. et al. (Jan. 2018, e-pub. Dec. 14, 2017). "Emerging Viral Diseases From a Vaccinology Perspective: Preparing for the Next Pandemic," Nat Immunol. 19(1):20-28.

Graham, R.L. et al. (Dec. 2013, e-pub. Nov. 11, 2013). "A Decade After SARS: Strategies for Controlling Emerging Coronaviruses," Nature Reviews Microbiology, 11:836-848.

Gupta, D. et al. (2021, e-pub. Apr. 23, 2021). "Inactivation of SARS-CoV-2 by β-propiolactone Causes Aggregation of Viral Particles and Loss of Antigenic Potential," 305:198555, 9 pages.

Han, Q. et al. (Apr. 2020, e-pub. Feb. 11, 2020). "Coronavirus 2019-nCOV: A Brief Perspective From the Front Line," J Infect. 80(4):373-377.

He, Y. et al. (Dec. 10, 2004, e-pub. Oct. 28, 2004). "Inactivated SARS-CoV Vaccine Elicits High Titers of Spike Protein-Specific Antibodies That Block Receptor Binding and Virus Entry," Biochem. Biophys. Res. Commun. 325(2):445-452.

Henikoff, S. et al. (Nov. 15, 1992). "Amino Acid Substitution Matrices From Protein Blocks," Proc. Nat'l Acad. Sci. USA 89:10915-10919.

Herrera-Rodriguez, J. et al. (Mar. 14, 2019, e-pub. Feb. 11, 2019). "Inactivated or Damages? Comparing the Effect of Inactivation Methods on Influenza Virions to Optimize Vaccines Production," Vaccine 37(12):1630-1637.

Hogan, R.J. et al. (Oct. 2004). "Resolution of Primary Severe Acute Respiratory Syndrome-Associated Coronavirus Infection Requires Stat1," J. Virol. 78(20):11416-11421.

Hombach, J. et al. (Nov. 1, 2005, e-pub. Jul. 18, 2005). "Report on a WHO Consultation on Immunological Endpoints for Evaluation of New Japanese Encephalitis Vaccines, WHO, Geneva, Sep. 2-3, 2004," Vaccine. 23(45):5205-5211.

Hotez, P.J. et al. (Jul. 2020). "COVID-19 Vaccines: Neutralizing Antibodies and The Alum Advantage," Nat. Rev. Immunol. 20(7):399-400.

Huh, K. et al. (Mar. 2020). "Emergent Strategies for the Next Phase of COVID-19," Infect Chemother. 52(1):105-109.

Hyer, R. et al. (2019, e-pub. Aug. 17, 2019). "Immunogenicity and Safety of a 2-Dose Hepatitis B Vaccine, HBsAg/CpG 1018, in Persons with Diabetes Mellitus Ages 60-70 Years," Vaccine 37(39):5854-5861.

Ioannou, X.P. et al. (Nov. 22, 2002). "CpG-Containing Oligodeoxynucleotides, In Combination With Conventional Adjuvants, Enhance The Magnitude and Change The Bias of the Immune Responses to a Herpesvirus Glycoprotein," Vaccine 21(1-2):127-137.

Jureka, A.S. et al. (Jun. 6, 2020). "Propagation, Inactivation, and Safety Testion of SARS-CoV-2," Viruses 12(6):622, 13 pages.

Khan, J. et al. (Apr. 2020). "We've Never Made a Successful Vaccine for a Coronavirus Before. This is Why It's So Difficult," ABC Health and Wellbeing, retrieved from the Internet https://www.abc.net.au/news/health/2020-04-17/coronavirus-vaccine-ian-frazer/12146616, last visited Sep. 20, 2021, 6 pages.

Kobinger, G.P. et al. (Jul. 9, 2007, e-pub. May 7, 2007). "Adenovirus-Based Vaccine Prevents Pneumonia in Ferrets Challenged With the SARS Coronavirus and Stimulates Robust Immune Responses in Macaques," Vaccine. 25(28):5220-5231.

Kulkarni, R. (Nov. 2019). "Antibody-Dependent Enhancement of Viral Infections," Dynamics of Immune Activation in Viral Diseases 5:9-41.

Kuo, T.-Y. et al. (2020). "Development of CpG-Adjuvanted Stable Prefusion SARS-CoV-2 Spike Antigen as a Subunit Vaccine Against COVID-19," Scientific Reports, 10:20085, 10 pages.

Lambert, P.-H. et al. (Jun. 26, 2020, e-pub. May 25, 2020). "Consensus Summary Report for CEPI/BC Mar. 12-13, 2020 Meeting: Assessment of Risk of Disease Enhancement With COVID-19 Vaccines," Vaccine 38(31):4783-4791, 10 pages.

Lan J. et al. (2014, e-pub. Nov. 18, 2014). "Tailoring Subunit Vaccine Immunity With Adjuvant Combinations and Delivery Routes Using the Middle East Respiratory Coronavirus (MERS-CoV) Receptor-Binding Domain as an Antigen," PLoS ONE 9(11):e112602, 9 pages.

Latimer, L.J.P. et al. (Oct. 1995). "Specificity of Monoclonal Antibodies Produced Against Phosphorothioate and Ribo Modified DNAs," Mol. Immunol. 32(14/15):1057-1064.

Lazarus, R. et al. (Dec. 2022, e-pub. Sep. 5, 2022). "Immunogenicity and Safety of an Inactivated Whole-Virus COVID-19 Vaccine (VLA2001) Compared with the Adenoviral Vector Vaccine ChAdOx1-S in Adults in the UK (COV-COMPARE): Interim Analysis of a Randomised, Controlled, Phase 3, Immunobridging Trial," Lancet Infect. Dis. 22:1716-1727, 12 pages.

Letko, M. et al. (Mar. 2020, e-pub. Feb. 24, 2020). "Functional Assessment of Cell Entry and Receptor Usage for SARS-CoV-2 and Other Lineage B Betacoronaviruses," Nature Microbiology, 5(4):562-569.

Li, J.-Y. et al. (Mar. 2020, e-pub. Feb. 2020). "The Epidemic of 2019-Novel-Coronavirus (2019-nCOV) Pneumonia and Insights for Emerging Infectious Diseases in the Future," Microbes Infect. 22(2):80-85.

(56) References Cited

OTHER PUBLICATIONS

Liang, J.G. et al. (2021, e-pub. Mar. 1, 2021). "S-Trimer, a COVID-19 Subunit Vaccine Candidate, Induces Protective Immunity in Nonhuman Primates," Nat Commun. 12(1):1346, 12 pages.

Lien, C.-E. et al. (2021, e-pub Apr. 22, 2021). CpG-Adjuvanted Stable Prefusion SARS-CoV-2 Spike Protein Protected Hamsters From SARS-CoV-2 Challenge, Scientific Reports, 11: 8761. 7 pages.

Lin, J.-T. et al. (2007). "Safety and Immunogenicity From a Phase I Trial of Inactivated Severe Acute Respiratory Syndrome Corona Virus Vaccine," Antivir. Ther. 12(7):1107-1113.

Luo, F. et al. (Apr. 2018, e-pub. Mar. 14, 2018). "Evaluation of Antibody-Dependent Enhancement of SARS-CoV Infection in Rhesus Macaques Immunized With an Inactivated SARS-CoV Vaccine," Virol Sin. 33(2):201-204.

Maisonnasse, P. et al. (Sep. 24, 2020, e-pub. Jul. 22, 2020). "Hydroxychloroquine Use Against SARS-CoV-2 Infection in Non-Human Primates," Nature 585(7826):584-587 and Supplemental Information, 18 pages.

Needleman, S. B. et al. (Mar. 1970). "A General Method Applicable to the Search for Similarities in the Amino Acid sequence of Two Proteins," J. Mol. Biol. 48:443-453.

* cited by examiner

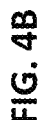
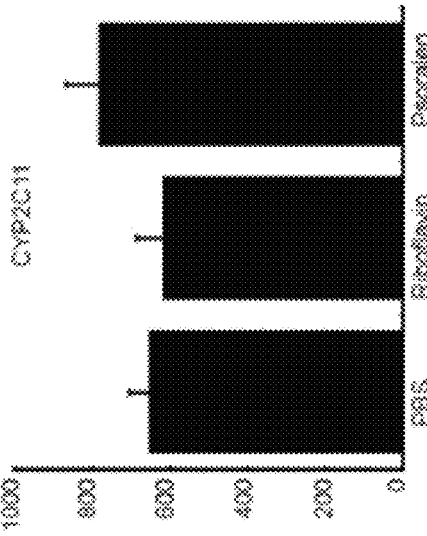
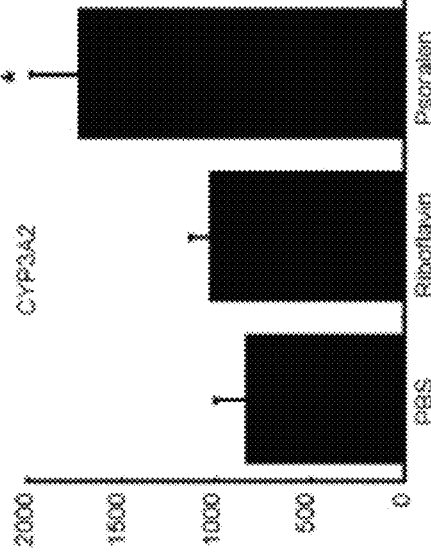

Cytokine secretion profiles of rats 6 h after systemic administration of adenovirus inactivated by riboflavin (AdlacZ + Riboflavin) or active virus alone (AdlacZ)[a]

| | IFN-γ (pg/ml) | IL-6 (pg/ml) | IL-12 (p70) (pg/ml) |
|---|---|---|---|
| PBS | 0 | 0 | 0 |
| AdlacZ + Riboflavin | 3,732±467.1 | 374.22±46.63 | 53.47±5.1 |
| AdlacZ | 5,585±331.9 | 525.53±97.82 | 75.45±4.96 |

[a] Values were determined by ELISA assays of serum collected from 4 animals per treatment group and reflect the average measurement ± S.E. of the mean.

Log Reduction in Middle East respiratory syndrome coronavirus titers after pathogen-reduction technology treatment: pooled plasma

| Replicate no. | Viral load, log PFU/mL* | | Log reduction |
|---|---|---|---|
| | Pretreatment | Posttreatment | |
| 1 | 6.24 | <2.18 | >4.06 |
| 2 | 6.23 | <2.18 | >4.05 |
| 3 | 6.27 | <2.18 | >4.09 |
| Average | 6.25 | <2.18 | >4.07 |

*Posttreatment titers were at the limit of detection for the assay.
†Replicates consist of pooled plasma units spiked with a known quantity of Middle East respiratory syndrome coronavirus.
PFU = plaque forming cells.

FIG. 7B

Log reduction in Middle East respiratory syndrome coronavirus titers after pathogen-reduction technology treatment: single-donor plasma

| Unit no. | Viral load, log PFU/mL* | | Log reduction |
|---|---|---|---|
| | Pretreatment | Posttreatment | |
| 1 | 6.49 | <2.00 | >4.49 |
| 2 | 6.49 | <2.00 | >4.49 |
| 3 | 6.49 | <2.00 | >4.49 |
| 4 | 6.49 | <2.00 | >4.49 |
| 5 | 6.36 | <2.00 | >4.36 |
| 6 | 6.39 | <2.00 | >4.39 |
| Average ± SD | 6.45 ± 0.06 | <2.00 ± N/A | >4.45 ± 0.06 |

*Posttreatment titers were at the limit of detection for the assay.
PFU = plaque forming units; SD = standard deviation; N/A = not applicable.

Viral Titer (Log$_{10}$ PFU/g)

Viral Titer (Log$_{10}$ PFU/g)

7 DPI

Severe broncho-interstitial pneumonia, subacute

3 DPI

Moderately severe broncho-interstitial pneumonia, acute

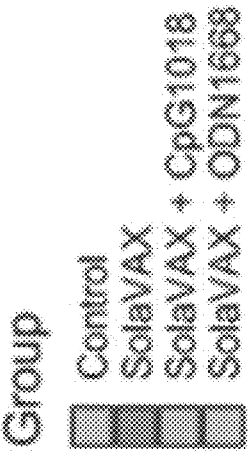
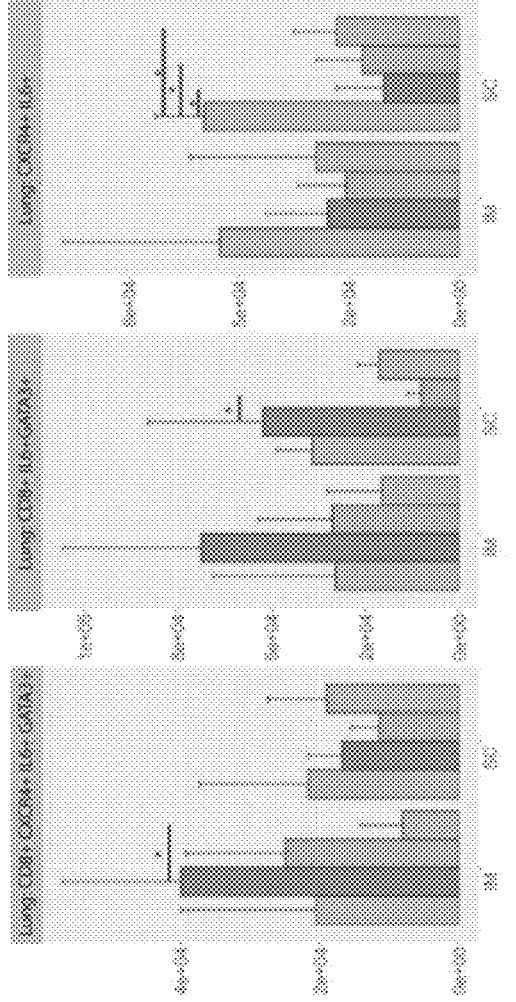
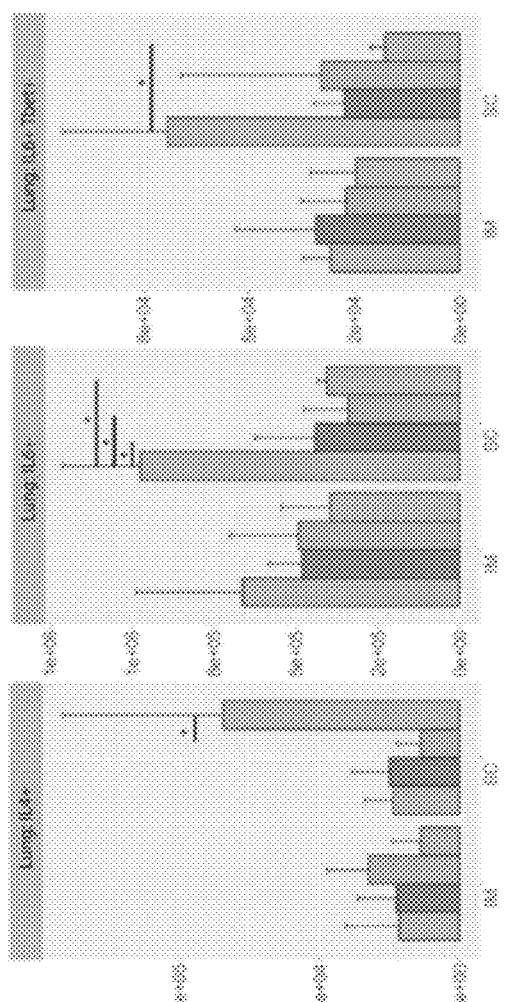
Average total numbers
FIG. 11B

Average total numbers

Group
Control
SolaVAX
SolaVAX + CpG1018
SolaVAX + ODN1668

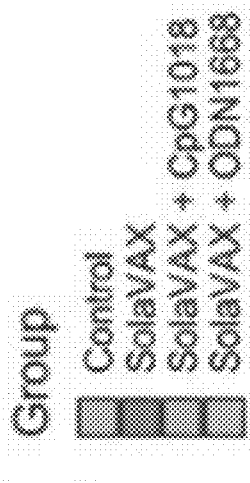
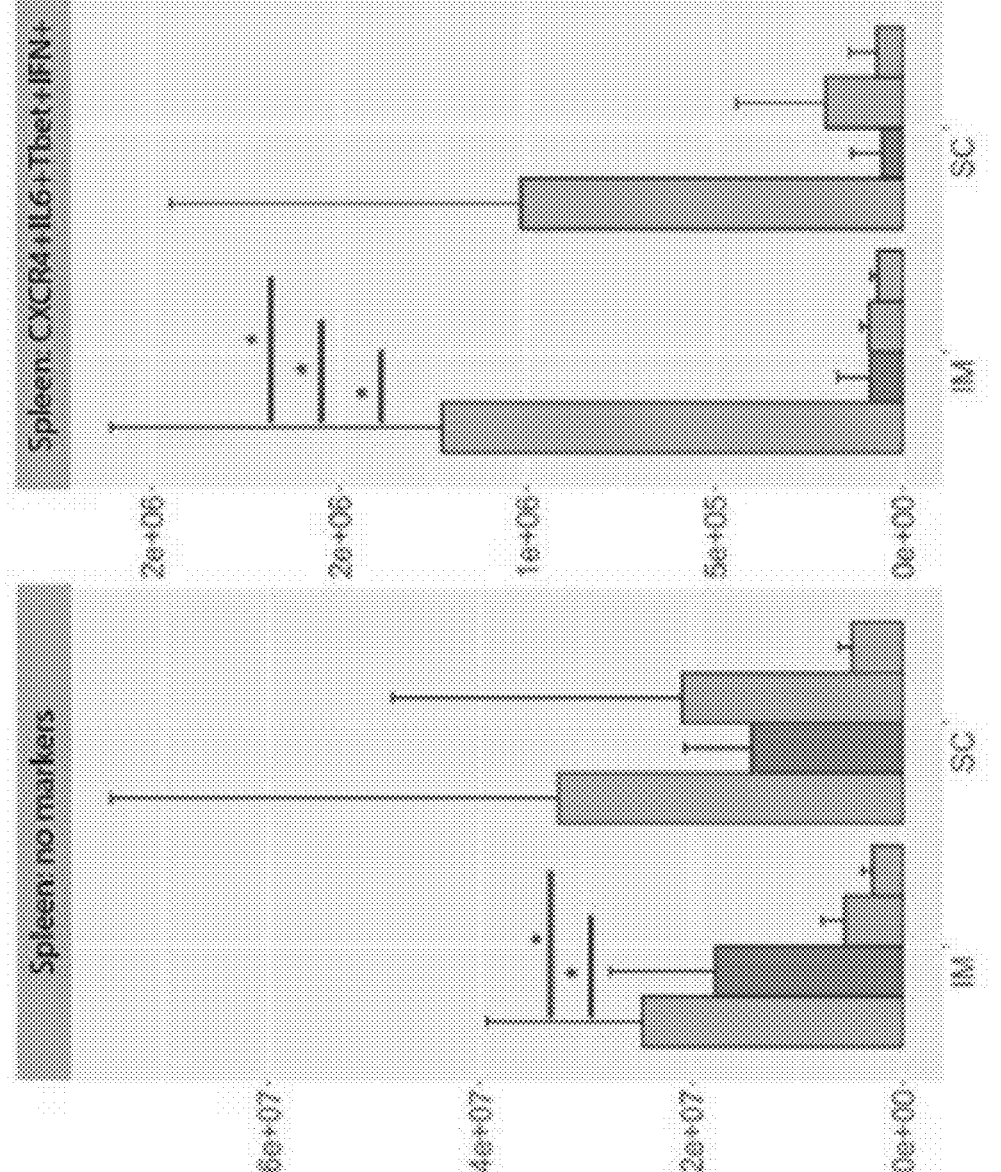
FIG. 13B

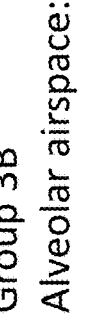
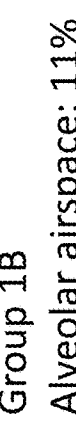
Group 3B
Alveolar airspace:
33%
Group 1B
Alveolar airspace: 11%
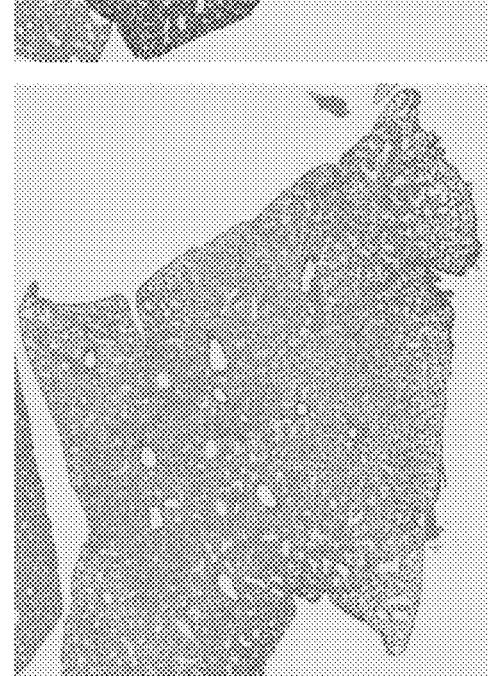
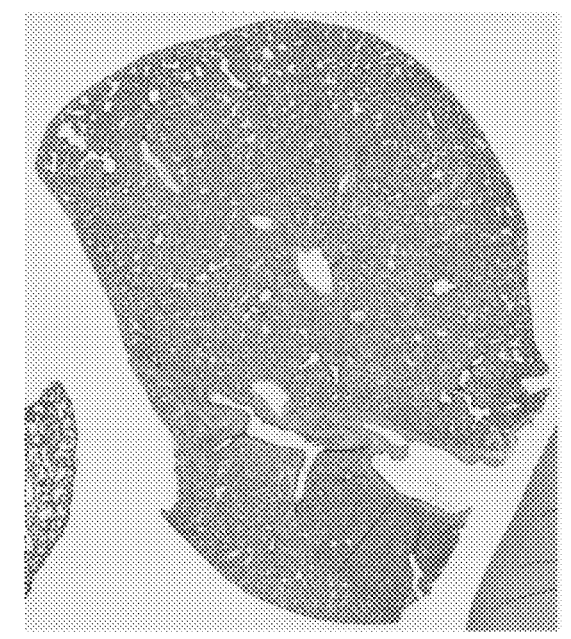
FIG. 17A

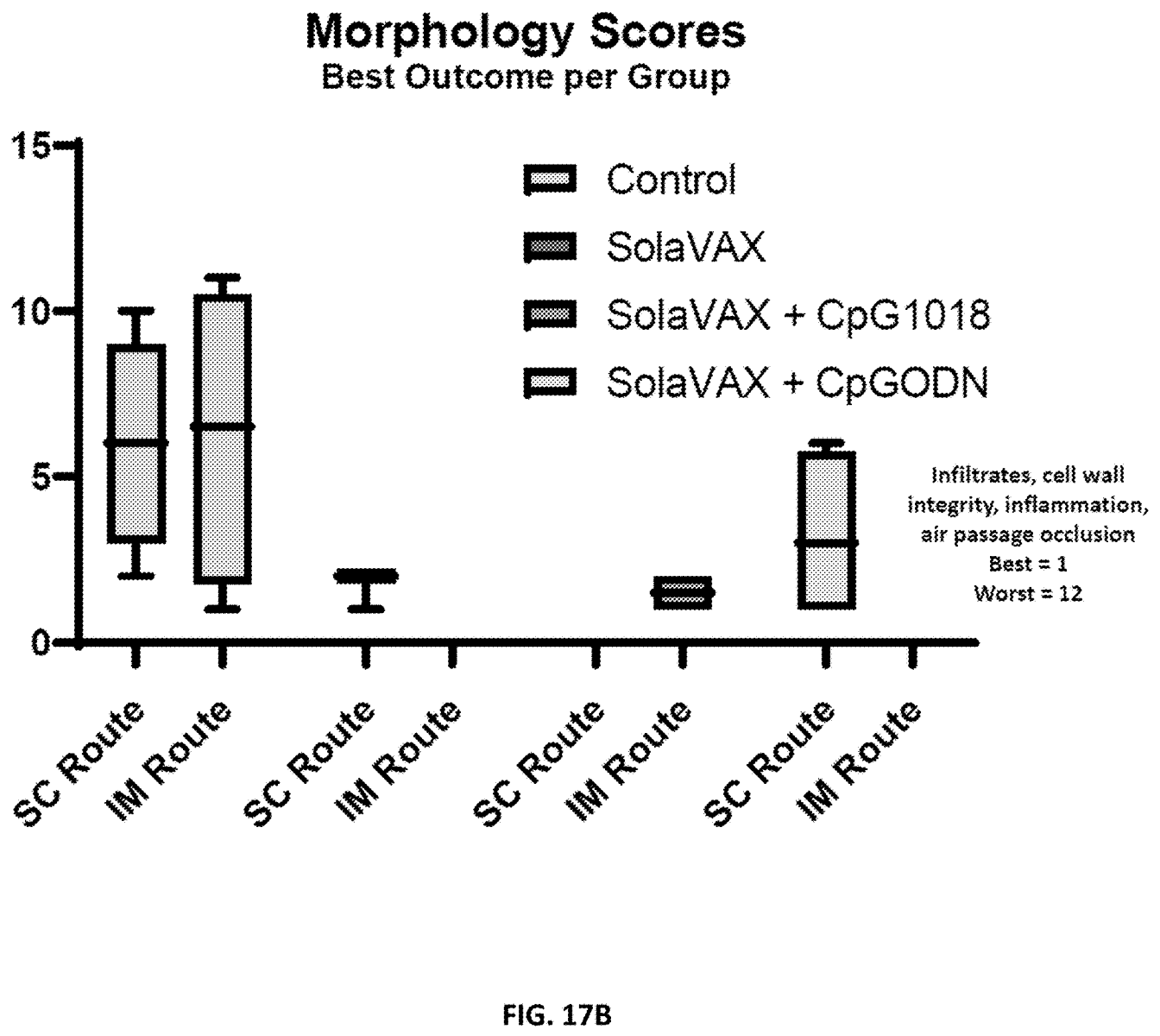

Morphology Scores
Best Outcome per Group

■ Control
■ SolaVAX
■ SolaVAX + CpG1018
■ SolaVAX + CpGODN

Infiltrates, cell wall integrity, inflammation, air passage occlusion
Best = 1
Worst = 12

SC Route
IM Route
SC Route
IM Route
SC Route
IM Route
SC Route
IM Route 15
10
5
0

FIG. 17B

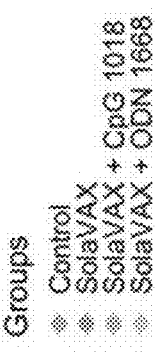
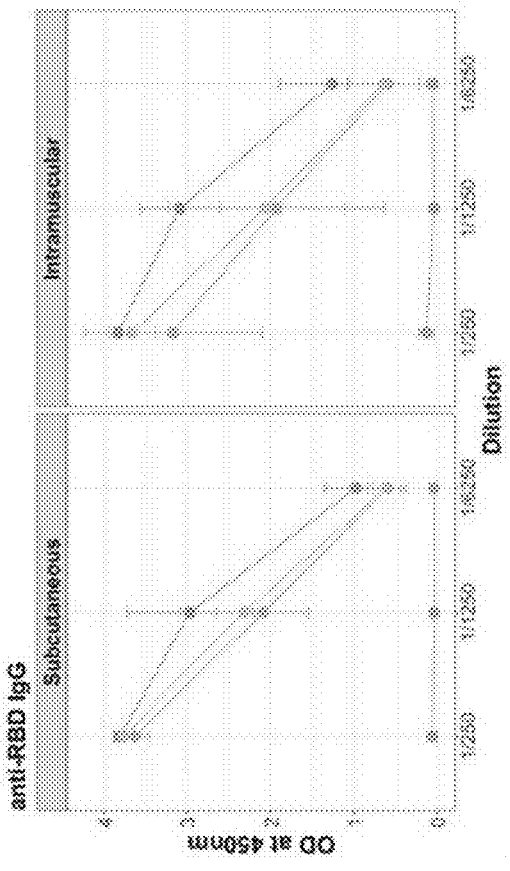
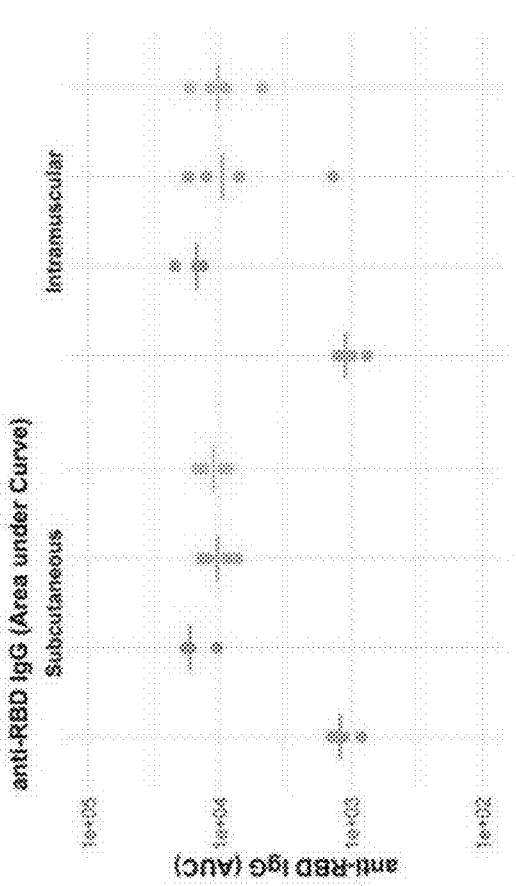
FIG. 18A

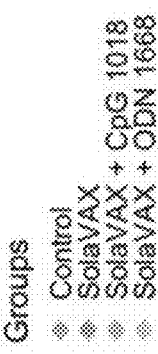
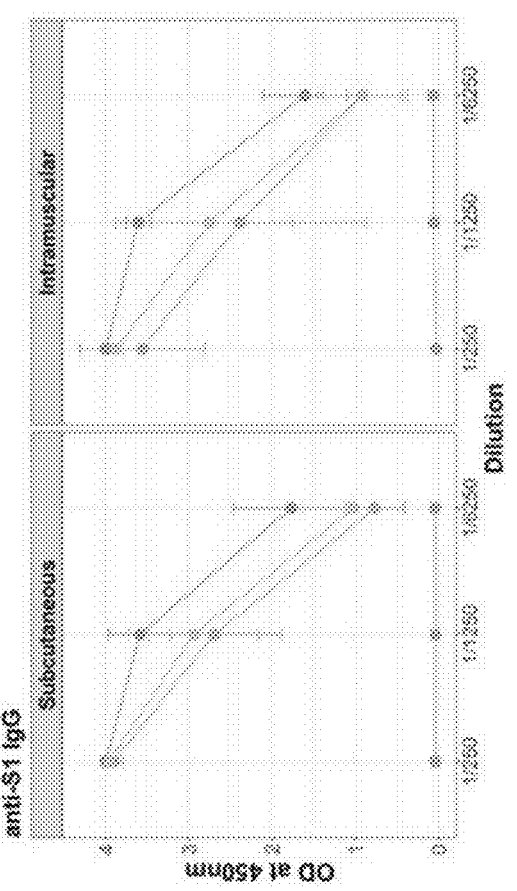
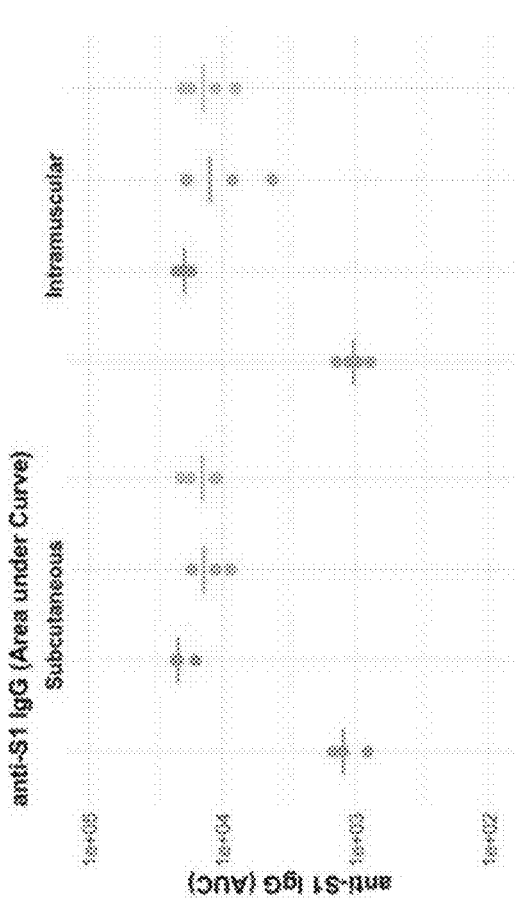
FIG. 18B

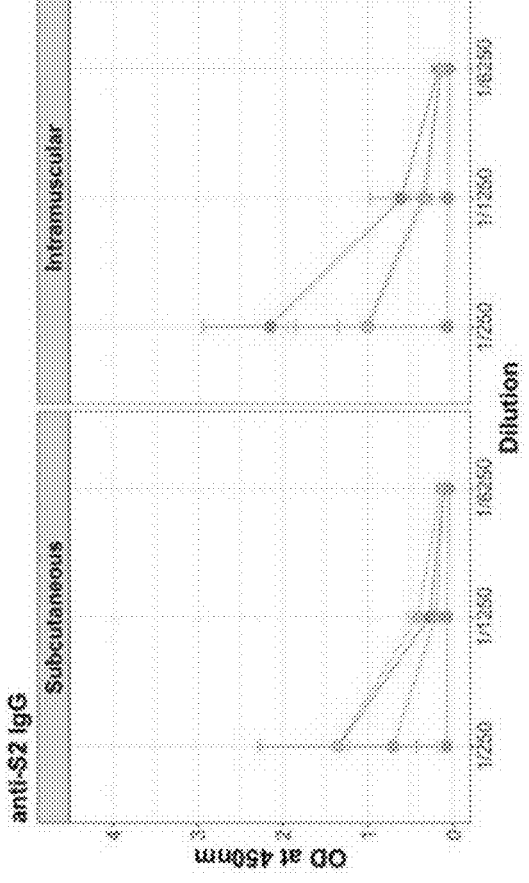
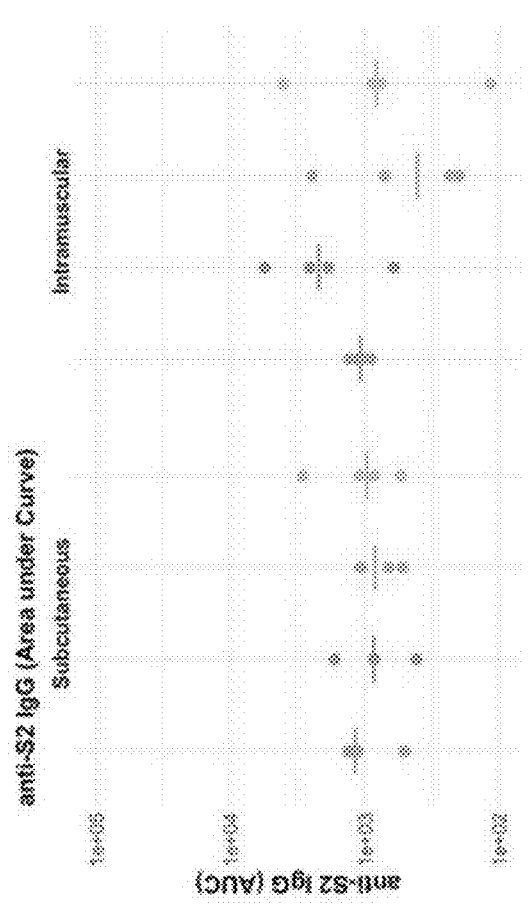
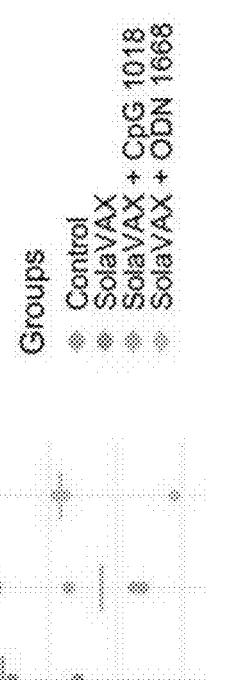
FIG. 18C

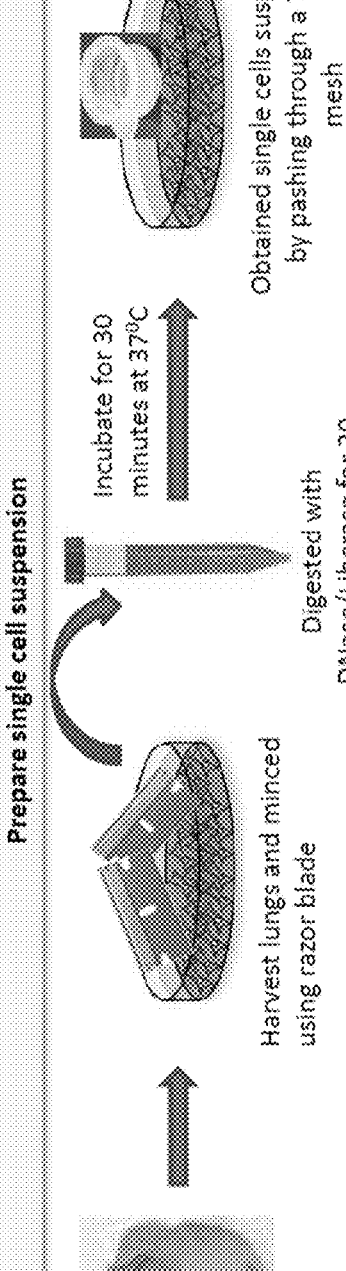
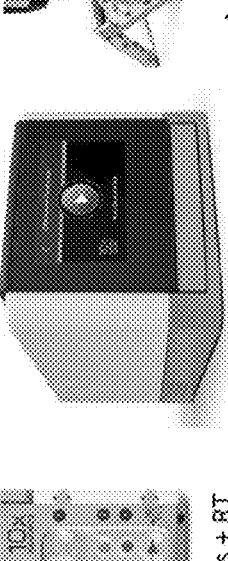
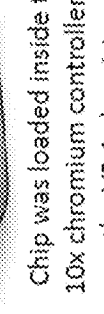
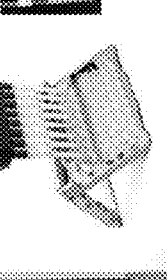
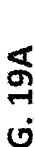

Single cell RNA sequencing methodology

Prepare single cell suspension

Harvest lungs and minced using razor blade

Digested with DNase/Liberase for 30 min at 37C.

Incubate for 30 minutes at 37°C

Obtained single cells suspensions by pushing through a 70 μm mesh

Load cells on 10x chromium chip and prepare 1st strand cDNA

Counted cells using hemocytometer

Loaded 12000 cells + RT reagent + Gel beads+ partitioning oil on the 10x Chromium chip G Chip was loaded inside the 10x chromium controller for the V3.1 chemistry Aspirate GEMs slowly and transfer it to the thermocycler for the recommended cycle

FIG. 19A

| Timeline | Day 0 | Day 21 | Day 41 | Day 42 | Day 45 | Day 49 | Day 92 |
|---|---|---|---|---|---|---|---|
| Actions | ID, bleed, vaccinate (prime) | Bleed, vaccinate (boost) | Bleed, move to BSL3 | Live virus challenge (challenge Groups 1A,1B,1C,2A, 2B only) | Necropsy (3 DPI) (Groups 1A and 2A only) | Necropsy (7 DPI) (Groups 1B and 2B only) | Weekly bleeding (Groups 1C and 2C only) |

FIG. 32A

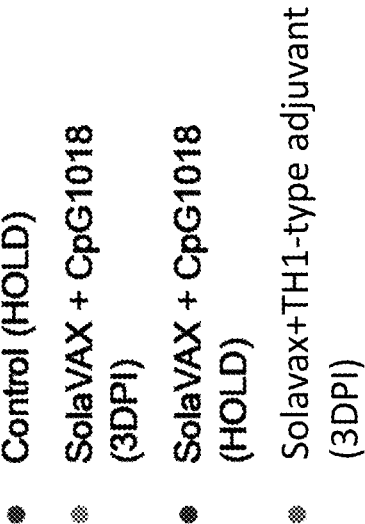
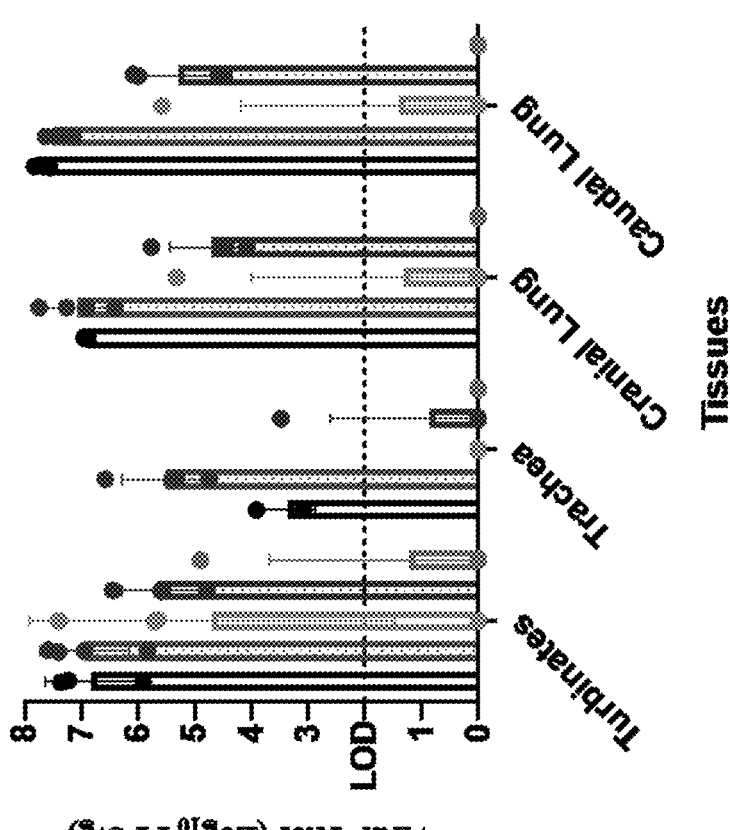
FIG. 35

PRODUCTION OF VACCINES COMPRISING INACTIVATED SARS-CoV-2 VIRAL PARTICLES

CROSS-REFERENCE TO RELATED APPLICATIONS

This application is a national stage application under 35 U.S.C. 371 of PCT Application No. PCT/US2021/021190 having an international filing date of Mar. 5, 2021, which designated the United States, which PCT application claimed the benefit of U.S. Application Ser. No. 62/986,160, filed Mar. 6, 2020, U.S. Application Ser. No. 63/039,786, filed Jun. 16, 2020, U.S. Application Ser. No. 63/055,041, filed Jul. 22, 2020, U.S. Application Ser. No. 63/079,251, filed Sep. 16, 2020, U.S. Application Ser. No. 63/079,278, filed Sep. 16, 2020, all of which are incorporated by reference in their entirety.

SEQUENCE LISTING

The instant application contains contents of the electronic sequence listing (90013-00051-Sequence-Listing. xml; Size: 649,096 bytes; and Date of Creation: Aug. 31, 2022) is herein incorporated by reference in its entirety.

TECHNICAL FIELD

The disclosure relates to inactivated viral vaccines and methods for preparing the same. More specifically, the disclosure relates to methods for inactivation of viral particles, including SARS-CoV-2 viral particles, using a photosensitizer such as riboflavin in combination with UV light.

SEQUENCE LISTING

The instant application contains a Sequence Listing which has been submitted electronically in ASCII format and is hereby incorporated by reference in its entirety. Said ASCII copy, created Apr. 19, 2023, is named "90013-00051-Sequence-Listing-AF.txt" and is 817,214 bytes in size.

BACKGROUND

Coronavirus disease 2019 (COVID-19), caused by the virus SARS-CoV-2, continues to spread globally leading to significant impacts on public health. As of Mar. 1, 2021, over 114 million total cases had been confirmed and over 2.53 million deaths had been reported globally. SARS-CoV-2, or Severe Acute Respiratory Syndrome coronavirus 2, causes primarily respiratory infections in humans and is related to other coronaviruses like Middle East Respiratory Syndrome 60 Coronavirus (MERS-CoV) and SARS-CoV. Not only has SARS-CoV-2 caused a public health emergency on a global scale but it continues to have major social, cultural, and economic impacts.

Vaccination is the most effective countermeasure for mitigating pandemics and has proven effective against viral pathogens such as smallpox and polio. Traditional vaccine production methods have included the use of RNA and DNA vaccines, subunit vaccines, attenuated vaccines, as well as vectored vaccines utilizing virus-like particles (VLP), adenovirus or bacterial host constructs. Inactivated vaccines have been a mainstay of vaccinology for decades. Even today, examples of inactivated vaccines include constructs for influenza, cholera, bubonic plague and polio. Inactivated viral vaccines are typically made by exposing virulent virus to chemical or physical agents, for example, formalin or β-propiolactone, in order to destroy infectivity. However, exposure to such harsh chemical and/or physical agents may destroy viral epitopes, thus reducing or even destroying immunogenicity.

Thus, there is a need in the art for improved compositions and methods for producing inactivated viral vaccines, which inactivate a virus particle's ability to replicate while preserving the potency and integrity of the antigenic proteins thereon. In particular, there is a need in the art for compositions and methods for producing an inactivated viral vaccine against SARS-CoV-2.

BRIEF SUMMARY

Provided herein are compositions and methods for producing inactivated viral vaccines, including vaccines against SARS-CoV-2, the virus responsible for COVID-19. The compositions and methods employ the use of a photochemical (e.g., riboflavin) in combination with UV light to carry out specific nucleic acid alterations through electron transfer chemistry-based processes. When combined with UV light, these photochemicals modify nucleic acid structure, likely primarily through modification of guanine bases. The specificity of the riboflavin photochemistry used in this process substantially avoids the alkylation, crosslinking and covalent modifications that are associated with other chemical and photochemical mechanisms of traditional viral inactivation. Unlike the standard chemical agents such as betapropiolactone and ethyleneimine derivatives that are routinely used for inactivated vaccine production, the photochemicals used in the disclosed approaches (e.g., riboflavin) have well-established safety toxicology profiles, are non-mutagenic and non-carcinogenic and pose little to no toxicity or disposal risk to facility personnel or the environment.

In some embodiments, a method for inactivating a SARS-CoV-2 particle is provided, wherein the method comprises contacting the SARS-CoV-2 particle with a dose of UV light in the presence of riboflavin. The dose of light may be about 100 Joules to about 1000 Joules. In some embodiments, the dose of UV light is about 100 Joules.

In some embodiments, the method comprises altering a nucleic acid of the SARS-CoV-2 particle. In some embodiments, the nucleic acid of the SARS-CoV-2 particle is an RNA. In some embodiments, the method comprises selectively oxidizing one or more guanine bases in the nucleic acid. In some embodiments, the UV light selectively oxidizes about 1 to about 30 guanine bases in the nucleic acid of the SARS-CoV-2 particle. In some embodiments, the UV light selectively oxidizes about 9 guanine bases in the nucleic acid of the SARS-CoV-2 particle. In some embodiments, the UV light selectively oxidizes about 20 guanine bases in the nucleic acid of the SARS-CoV-2 particle. In some embodiments, the method does not comprise substantially altering the structure of antigens on the surface of the SARS-CoV-2 particle.

In some embodiments, the inactivated SARS-CoV-2 particle is not capable of replicating in a cell. In some embodiments, the inactivated SARS-CoV-2 particle is not capable of causing disease in a subject.

Also provided herein is a vaccine composition comprising a SARS-CoV-2 particle inactivated according to a method described herein.

Also provided herein is a vaccine composition comprising an inactivated SARS-CoV-2 viral particle, wherein the SARS-CoV-2 genome comprises one or more oxidized guanine residues.

Also provided is a vaccine composition comprising an inactivated SARS-CoV-2 viral particle, and an adjuvant that is capable of promoting a Th1-type immune response.

Also provided herein is a vaccine composition comprising an inactivated SARS-CoV-2 viral particle; wherein the composition comprises about 15 to about 50 picograms of SARS-CoV-2 protein and an adjuvant; and wherein the adjuvant is a phosphorothioate oligonucleotide comprising about 15 to about 30 nucleotides.

Also provided herein is a vaccine composition comprising an inactivated SARS-CoV-2 viral particle; wherein the SARS-CoV-2 genome comprises about 1 to about 30 oxidized guanine residues; wherein the structure of antigens on the viral particle is not substantially altered compared to SARS-CoV-2 viral particle that has not been inactivated.

In some embodiments, the vaccine compositions described herein comprise about 1 to about 100 picograms of SARS-CoV-2 protein. In some embodiments, the composition comprises about 15 to about 50 picograms of SARS-CoV-2 protein. In some embodiments, the composition comprises about 35 picograms of SARS-CoV-2 protein.

In some embodiments, the vaccine composition comprises an adjuvant. In some embodiments, the adjuvant is capable of promoting a Th1-type immune response. In some embodiments, the adjuvant is capable of limiting a Th2-type response. In some embodiments, the adjuvant is CpG and/or AS01. In some embodiments, the adjuvant is a phosphorothioate oligonucleotide comprising about 15 to about 30 nucleotides. In some embodiments, the adjuvant comprises a nucleic acid that comprises the sequence 5'-TGACTGT-GAACGTTCGAGATGA-3' (SEQ ID NO: 21). In some embodiments, the adjuvant comprises a nucleic acid that comprises the sequence 5'-TCCATGACGTTCCTGATGCT-3' (SEQ ID NO: 22). In some embodiments, the adjuvant is ODN 1668. In some embodiments, the adjuvant is CpG 1018. In some embodiments, the composition comprises a pharmaceutically acceptable carrier or excipient.

In some embodiments, the vaccine comprises an inactivated SARS-CoV-2 particle, wherein the SARS-CoV-2 genome comprises about 1 to about 30 oxidized guanine bases. In some embodiments, the SARS-CoV-2 genome comprises about 9 oxidized guanine bases. In some embodiments, the SARS-CoV-2 genome comprises about 20 oxidized guanine bases.

In some embodiments, the vaccine composition comprises a pharmaceutically acceptable carrier or excipient.

Also provided herein is a method for treating or preventing a viral infection in a subject in need thereof, the method comprising administering to the subject an effective amount of the vaccine composition as described herein. In some embodiments, the subject is a mammal. In some embodiments, the subject is a human. In some embodiments, the vaccine is administered intramuscularly. In some embodiments, the vaccine is administered subcutaneously.

In some embodiments, a first vaccine composition and a second vaccine composition are administered to the subject. In some embodiments, the amount of viral protein in the first vaccine composition is greater than the amount of viral protein in the second vaccine composition. In some embodiments, the amount of viral protein in the first vaccine composition is less than the amount of viral protein in the second vaccine composition. In some embodiments, the amount of viral protein in the first vaccine composition is about the same as the amount of viral protein in the second vaccine composition. In some embodiments, the second vaccine composition is administered about 1 week, about 2 weeks, about 3 weeks, about 4 weeks, about 2 months, about 3 months, about 4 months, about 5 months, about 6 months, or about 1 year after the first vaccine composition. In some embodiments, the second vaccine composition is administered about 3 weeks after the first vaccine composition.

Also provided herein is a method for producing a viral vaccine, the method comprising (i) providing a plurality of SARS-CoV-2 particles, and (ii) inactivating the particles by contacting them with UV light in the presence of riboflavin. In some embodiments, the method comprises purifying the inactivated SARS-CoV-2 particles.

Also provided herein is a method for inactivating a SARS-CoV-2 viral particle, the method comprising contacting the SARS-CoV-2 viral particle with a dose of UV light in the presence of riboflavin; wherein the dose of UV light is about 100 Joules to about 1000 Joules; wherein the method comprises selectively oxidizing about 1 to about 30 guanine bases in a nucleic acid of the viral particle; and wherein the method does not comprise substantially altering the structure of antigens on the viral particle. In some embodiments, the method comprises selectively oxidizing about 9 guanine bases in the nucleic acid of the viral particle. In some embodiments, the method comprises selectively oxidizing about 20 guanine bases in the nucleic acid of the viral particle. In some embodiments, the nucleic acid of the viral particle is an RNA.

These and other embodiments will be described in further detail below.

BRIEF DESCRIPTION OF THE DRAWINGS

FIG. 2A is a time course of inactivation for recombinant adeno-associated virus (AAV). Recombinant AAV expressing the beta-galactosidase transgene was mixed with either psoralen (1.5 mM) or riboflavin (50 μM) and exposed to UV light. Exposure to long wavelength UV light ("UV only") altered virus infectivity but did not completely inactivate the virus. FIG. 2B shows that treatment with either riboflavin or psoralen alone can reduce the infectious titer of recombinant AAV. AAV preparations were incubated with each reagent at room temperature for 2 hours. Titer of each preparation was assessed before and after treatment. There was no significant difference in titer of a preparation incubated in buffer in the absence of photosensitizer for the same time period (data not shown). FIG. 2C shows the kinetic profile of lentivirus inactivation in the presence of photosensitizers. Preparations treated with 50 μM riboflavin in the presence of UV light were completely inactivated within 20 minutes while treatment with 1.5 mM psoralen and UV light inactivated the virus in approximately 2 hours. FIG. 2D shows that exposure of lentivirus to UV light or photosensitizers alone can compromise infectious titer. Lentivirus was incubated with each photochemical at room temperature or exposed to UV light for 2 hours. Titer of each preparation was assessed before (Pre-Tx) and after treatment. Data in each panel are presented as mean values obtained from three independent studies+S.E. **p=0.04, *p=0.05, one way analysis of variance with a Bonferroni/Dunn post hoc test.

FIG. 3A shows particle size distribution of recombinant AAV mixed with 50 μM riboflavin and exposed to UV light as determined by dynamic light scattering. This preparation initially consisted of a mixture of single, intact virus particles and large aggregated in equal proportion. At later time points, the majority of the preparation consisted of large viral aggregated with an average hydrodynamic radius greater than 60 nm. FIG. 3B shows particle size analysis of an AAV preparation mixed with 1.5 mM psoralen and exposed to UV light. No significant change in particle size distribution could be detected in the preparation during the inactivation process. FIG. 3C shows a representative electron micrograph illustrating the presence of single intact particles and large aggregates present in an AAV preparation prior to treatment with riboflavin and UV light. Magnification: 80,000×. FIG. 3D shows a representative electron micrograph illustrating the presence of few intact single virus particles and many large aggregates after 90 min of exposure to riboflavin and UV light. Magnification: 50,000×.

FIG. 4A-4B is experimental data showing that residual riboflavin remaining in a vaccine composition after viral inactivation does not induce toxicity in rats. Specifically, riboflavin alone does not affect the activity of hepatic CYP3A2 (FIG. 4A) and 2C11 (FIG. 4B). Rats were treated with: phosphate buffered saline (vehicle), riboflavin (50 μM, effective dose 36.2 μg/kg) or psoralen (1.5 mM, effective dose 625 μg/kg) and sacrificed 6 hours after treatment. In vitro catalytic activity of hepatic CYP3A2 microsomal proteins was measured by the production of the testosterone metabolite, 6β-hydroxytestosterone. Hepatic CYP2C11 activity was determined by measuring the production of the isoform-specific testosterone metabolite, 2α-hydroxytestosterone. Values are presented as the mean±S.E. of 4 animals/treatment/time point. Statistical significance was determined between individual treatment groups and saline controls by one-way analysis of variance with a Bonferroni/Dunn post hoc analysis. *p≤0.05.

FIG. 5 is a table showing that inactivated viral vaccine compositions induced immunological responses in rats without inducing expression of virus-mediated transcription of transgene product.

FIG. 7A-7B is experimental data showing reduction in Middle East Respiratory Syndrome (MERS) coronavirus titers after treatment with riboflavin and UV light.

FIG. 11A-11B shows statistically significant flow cytometry populations in lung within intramuscular and subcutaneously vaccinated groups. FIG. 11A is a schematic showing marker expression in various cell populations as determined using flow cytometry. The bar plots of FIG. 11B show the statistically significant populations identified through cyto-feature engineering for lung. The x-axis shows the groups studied. The average total numbers of cells for each group were calculated and shown (y-axis). The population names listed at the top of each small plot indicates the flow cytometry markers that are positive in the population. Note that these populations are negative for all of the other markers in the panel. The data is shown, from left to right, for control hamsters, SolaVAX treated hamsters, SolaVAX+CpH1018 treated hamsters, and SolaVAX+ODN1668 treated hamsters.

FIG. 12A is a schematic showing marker expression in various cell populations as determined using flow cytometry. The bar plots of FIG. 12B show the statistically significant populations identified through cyto-feature engineering for blood. The x-axis shows the groups studied. The average total numbers of cells for each group were calculated and shown (y-axis). The population names listed at the top of each small plot indicates the flow cytometry markers that are positive in the population. Note that these populations are negative for all of the other markers in the panel. The data is shown, from left to right, for control hamsters, SolaVAX treated hamsters, SolaVAX+CpH1018 treated hamsters, and SolaVAX+ODN1668 treated hamsters.

FIG. 13A-13B shows statistically significant flow cytometry populations in spleen within intramuscular and subcutaneously vaccinated groups. FIG. 13A is a schematic showing marker expression in various cell populations as determined using flow cytometry. The bar plots of FIG. 13B show the statistically significant populations identified through cyto-feature engineering for spleen. The x-axis shows the groups studied. The average total numbers of cells for each group were calculated and shown (y-axis). The population names listed at the top of each small plot indicates the flow cytometry markers that are positive in the population. Note that these populations are negative for all of the other markers in the panel. The data is shown, from left to right, for control hamsters, SolaVAX treated hamsters, SolaVAX+CpH1018 treated hamsters, and SolaVAX+ODN1668 treated hamsters.

FIG. 17A provides representative images from a morphometric analysis of lung alveolar airspace. The lung alveolar airspace is marked in green. The bottom panel shows representative images from the lungs of a hamster in vaccination group 1B (unvaccinated) the top panel shows representative images from the lungs of a hamster in vaccination group 3B (vaccinated with inactivated SARS-CoV-2 plus CpG 1018 adjuvant). FIG. 17B provides morphology scores as determined using representative histopathology images of the lung alveolar airspace. A 12-point scale was used, wherein 1 was the "best" (healthiest morphology) and 12 was the "worst" (most evidence of disease). Scores were determined by measuring number of infiltrates, cell wall integrity, inflammation, and air passage occlusion.

FIG. 18A-18C shows the results of ELISAs measuring serum reactivity to receptor binding domain (RBD) (FIG. 18A) and S1 (FIG. 18B) and S2 (FIG. 18C) protein. Graphs on the top panels shows optical density (OD) at 450 nm (y-axis) vs serum dilutions (x-axis). Values represent mean+/−SD, n=4. Bottom panels show area under the curve (AUC) calculated for each dilution for individual hamsters. In the bottom panels, data from the following groups are shown (from left to right): Control, SolaVAX, SolaVAX+CpG1018, and SolaVAX+ODN 1668.

FIG. 19A-19B show the experimental protocol used for single-cell RNA sequencing as described in Example 8. Briefly, lung tissues were harvested from hamsters vaccinated and challenged with SARS-CoV-2 (See FIG. 16), and minced using a razor blade. The cells were then digested with DNAse/Liberase, and single cell suspensions were obtained by passing the samples through a 70 micrometer mesh filter. After cells were counted, they were loaded onto a 10× chromium chip in the presence of RT reagent, gel beads, and partitioning oil. The chip was loaded into the 10× chromium controller. The gel beads in emulsion (GEMs) were aspirated slowly and transferred to the thermocycler, in order to prepare first strand cDNA. After cDNA amplification, a library was prepared and sequenced using the NextSeq 500 platform (Illumina©).

FIG. 20A shows merged UMAP visualization of 5466 single cells Control, SolaVAX, CpG and ODN vaccinated hamsters via IM administration. "UMAP" stands for Unified Manifold Approximation and Projection. Each cell population (marked with a different color) indicates grouping of cells into T cells, myeloid, B cells and epithelial cells based on transcriptional similarity. FIG. 20B shows the proportion of T, B, myeloid and epithelial cell types in each group. FIG. 20C shows normalized expression of known genes on a UMAP plot to identify different cell types. FIG. 20D shows UMAP projection to visualize 17 different cell types visualized after sub clustering the major cell types at higher resolution. Also shown is the percentage of each cell subtype of T (FIG. 20E), myeloid (FIG. 20F), B cells and epithelial cells (FIG. 20G). Significance value was calculated using ANOVA. p>0.05 was considered significant.

In FIG. 24A, trachea with dense submucosal lymphocytic and neutrophilic inflammation infiltrating mucosal epithelium (arrow) and accumulation of neutrophils within the tracheal lumen (arrowhead) is shown. In FIG. 24B, trachea with mild submucosal lymphocytic inflammation is shown. In FIG. 24C, large bronchus with dense lymphocytic and suppurative inflammation in the interstitium (arrow) and accumulation of neutrophils in the lumen with loss of mucocal epithelium (arrowhead) is shown. In FIG. 24D, Large bronchus minimally affected by inflammation (arrow) is shown. In FIG. 24E, effacement of lung alveolar tissue by consolidating interstitial pneumonia (arrow) and overall decrease in alveolar air space (arrowhead) is shown. In FIG. 24F, interstitial pneumonia increasing alveolar wall thickness (arrowhead) is shown, without compromising alveolar air space (arrowhead).

FIG. 32A shows a protocol for vaccinating, inoculating, and analyzing samples from hamsters vaccinated with an inactivated SARS-CoV-2 viral vaccine (SolaVAX), in the second challenge study.

FIG. 35 shows viral titer in the turbinates, trachea, cranial lung, and caudal lung, in various treatment groups of the second challenge study, including unvaccinated hamsters (control), hamsters vaccinated with inactivated SARS-CoV-2 viral vaccine plus the CpG1018 adjuvant (SolaVAX+ CpG 1018), and hamsters vaccinated with inactivated SARS-CoV-2 viral vaccine plus a different adjuvant capable of eliciting a Th1-type immune response (Solavax+Th1-type adjuvant). The groups labeled HOLD were vaccinated at day 0, but not challenged with virus until day 92. The other groups shown were vaccinated at day 0, and challenged with virus at day 42. Horizontal line shows the calculated limit of detection (LOD).

DETAILED DESCRIPTION

Figures 1A, 1B, 1C:
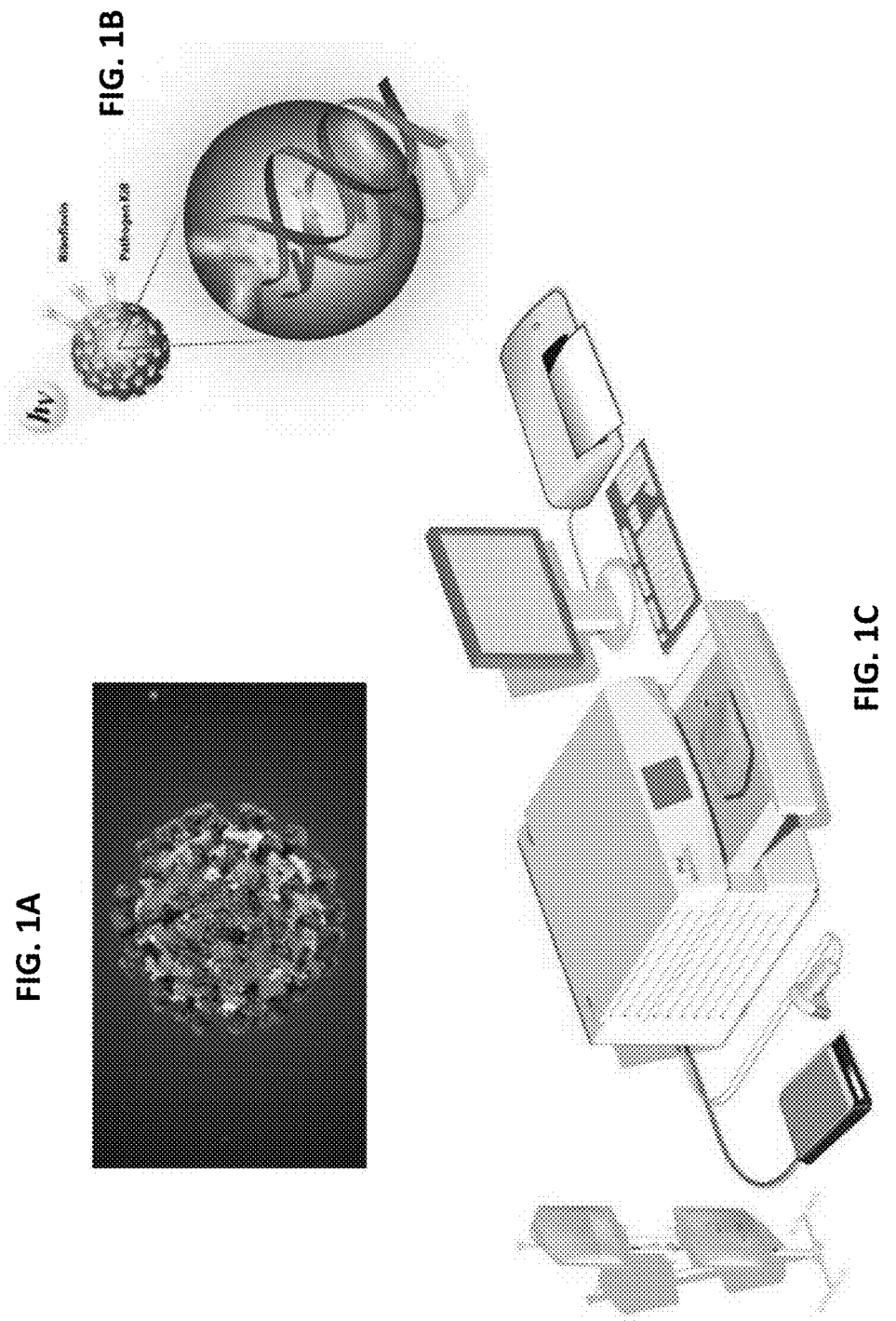
FIG. 1A is an illustration of an exemplary viral capsid comprising one or more protein and/or lipid antigens on its surface.
FIG. 1B is a schematic of an exemplary method for preparing an inactivated viral vaccine. A viral particle is contacted with light (hv), such as ultraviolet light, in the presence of a photosensitizer, such as riboflavin. Viral DNA and/or RNA is modified, while leaving protein (including cell surface antigens) substantially unaltered in the process.
FIG. 1C is a schematic of an exemplary UV light source (Mirasol® PRT Illumination device, TerumoBCT, Lakewood, Colorado), which may be used in the disclosed methods for inactivating viral particles.

Described herein are compositions and methods for producing inactivated viral vaccines, including vaccines for SARS-CoV-2. The compositions and methods disclosed herein take advantage of a unique property of the photosensitizer riboflavin and UV light to selectively inactivate virus particles by directed damage to nucleic acids while preserving the integrity of the proteins and other viral antigens. The nature of the photosensitizer (riboflavin) provides for low toxicity and thus easy handling, distribution and processing under even austere conditions.

In some embodiments, the disclosed methods can produce up to 3 million doses of vaccine in less than 5 minutes, making rapid and affordable production of an inactivated vaccine both practical and cost-effective. Throughput calculations indicate that within 1 month, a sufficient amount of vaccine product can be manufactured for every person on the planet at a reasonable cost, using disclosed compositions and methods.

A significant advantage of the disclosed methods is that the photochemical, riboflavin, is inexpensive, has been demonstrated to be non-toxic (Reddy et al.) and does not pose safety or environmental concerns. This stands in sharp contrast to many of the agents currently in use for preparation of inactivated vaccines such as glutaraldehyde, formaldehyde, Aldrithiol-2, ethyleneimine derivatives and irradiation technologies. The use of these inactivating chemistries requires facilities for production in very specialized operations with training for personnel and waste disposal processes that are cumbersome and difficult to produce in mobile facilities and operation under austere environmental conditions.

Another advantage is that the specific chemistry induced by riboflavin/UV inactivation allows more virus vaccine candidates to be prepared via this route, since the selectivity in chemistry is more likely to preserve labile and sensitive antigen profiles that are destroyed by the methods commonly used in the art. Such production methods, including VRP (virus replication particle) and VLP (virus-like particle) technology platforms, often require multiple steps of disassembly and re-assembly under controlled conditions.

In the processes described herein, the virus or target agent is inactivated in situ in its native form. The processes described herein inactivate nucleic acid replication without requiring additional processing steps to remove replication potential in the target agent. This approach is therefore useful to enhance the safety profile for viral vaccine candidates that contain nucleic acids. Such a reduction in processing steps and the requirements for extended protein stability throughout processing easily extend the application of this approach to agents generally considered up to this point to not be amenable to preparation of vaccine candidates. Thus, the disclosed approach allows for vaccine production in an austere environment with minimal facility and personnel training needs.

The vaccine compositions described herein can be used, for example, for vaccination of at-risk subjects, including healthcare workers and those working with potentially infected animals.

Unless otherwise defined, all technical and scientific terms used herein have the same meaning as commonly understood by one of ordinary skill in the art to which this disclosure belongs. The terminology used in the detailed description herein is for the purpose of describing particular embodiments only and is not intended to be limiting.

Definitions

The following terms are used in the description herein and the appended claims:

The singular forms "a," "an" and "the" are intended to include the plural forms as well, unless the context clearly indicates otherwise.

Furthermore, the term "about" as used herein when referring to a measurable value such as an amount, dose, time, temperature, and the like, is meant to encompass variations of ±20%, ±10%, ±5%, ±1%, ±0.5%, or even ±0.1% of the specified amount.

Also as used herein, "and/or" refers to and encompasses any and all possible combinations of one or more of the associated listed items, as well as the lack of combinations when interpreted in the alternative ("or").

As used herein, the terms "reduce," "reduces," "reduction" and similar terms mean a decrease of at least about 10%, about 15%, about 20%, about 25%, about 35%, about 50%, about 75%, about 80%, about 85%, about 90%, about 95%, about 97% or more.

As used herein, the terms "enhance," "enhances," "enhancement" and similar terms indicate an increase of at least about 10%, about 15%, about 20%, about 25%, about 50%, about 75%, about 100%, about 150%, about 200%, about 300%, about 400%, about 500% or more.

By the terms "treat," "treating" or "treatment of" (and grammatical variations thereof) it is meant that the severity of the subject's condition is reduced, at least partially improved or stabilized and/or that some alleviation, mitigation, decrease or stabilization in at least one clinical symptom is achieved and/or there is a delay in the progression of the disease or disorder.

The terms "prevent," "preventing" and "prevention" (and grammatical variations thereof) refer to prevention and/or delay of the onset of a disease, disorder and/or a clinical symptom(s) in a subject and/or a reduction in the severity of the onset of the disease, disorder and/or clinical symptom(s) relative to what would occur in the absence of the methods of the disclosure. The prevention can be complete, e.g., the total absence of the disease, disorder and/or clinical symptom(s). The prevention can also be partial, such that the occurrence of the disease, disorder and/or clinical symptom(s) in the subject and/or the severity of onset is less than what would occur in the absence of the present disclosure.

"Effective amount" as used herein refers to an amount that, when administered to a subject for treating or preventing a disease (e.g., a viral infection), or at least one of the clinical symptoms of a disease, is sufficient to affect such treatment or prevention of the disease or symptom thereof. The "effective amount" may vary depending, for example, on the disease and/or symptoms of the disease, severity of the disease and/or symptoms of the disease or disorder, the age, weight, and/or health of the subject to be treated, and the judgment of the prescribing physician. An appropriate amount in any given instance may be ascertained by those skilled in the art or capable of determination by routine experimentation.

Unless otherwise indicated, percent identity is determined herein using the BLAST algorithm available on the World Wide Web at the following address: blast.ncbi.nlm.nih.gov/Blast.cgi.

As used herein, the term "COVID-19 disease" refers to a disease caused by the severe acute respiratory syndrome coronavirus 2 (SARS-CoV-2). SARS-CoV-2 was first discovered in Wuhan, China in December 2019. SARS-CoV-2 is an enveloped, non-segmented, positive-sense RNA virus. SARS-CoV-2 shares a high degree of amino acid and nucleic acid sequence similarity with SARS-CoV across its entire genome. The terms "the virus responsible for COVID-19" and "COVID-19 virus" are used herein to refer to SARS-CoV-2. In some embodiments, the SARS-CoV-2 is an S strain of SARS-CoV-2. In some embodiments, the SARS-CoV-2 is an L strain of SARS-CoV-2. In some embodiments, the SARS-CoV-2 is any strain of SARS-CoV-2 now known or later discovered. In some embodiments, the SARS-CoV-2 has a genome with the sequence of SEQ ID NO: 20, or a sequence with about 80%, about 85%, about 90%, about 91%, about 92%, about 93%, about 94%, about 95%, about 96%, about 97%, about 98%, or about 99% sequence identity relative thereto. In some embodiments, the SARS-CoV-2 has a genome with about 1 to about 100, about 100 to about 250, or about 250 or about 500 nucleic acid substitutions relative to SEQ ID NO: 20. In some embodiments, the SARS-CoV-2 has a genome sequence with at least about 80%, about 85%, about 90%, about 91%, about 92%, about 93%, about 94%, about 95%, about 96%, about 97%, about 98%, or about 99% sequence identity relative isolate USA-WA1, NR-522881 (GenBank® Accession No. MN985325.1, SEQ ID NO: 23). In some embodiments, the SARS-CoV-2 has a genome sequence with about 1 to about 100, about 100 to about 250, or about 250 or about 500 nucleic acid substitutions relative to SEQ ID NO: 23. In some embodiments, the SARS-CoV-2 has a genome sequence with a G to A substitution at position 23616 of the genome (relative to SEQ ID NO: 23), which is results in an arginine to histidine substitution at position 685 within the polybasic cleavage site of the spike protein.

In some embodiments, the SARS-CoV-2 has a genome with a sequence as shown in Table 1. In some embodiments, the SARS-CoV-2 has a genome with about 1 to about 100, about 100 to about 250, or about 250 or about 500 nucleic acid substitutions relative to the sequences shown in Table 1. In some embodiments, the SARS-CoV-2 has a genome with about 90%, about 91%, about 92%, about 93%, about 94%, about 95%, about 96%, about 97%, about 98%, or about 99% sequence identity relative to the sequences shown in Table 1.

TABLE 1

Illustrative SARS-COV-2 genome sequences*

| GenBank ® Accession No. | Collection Date | Locality | SEQ ID NO: |
|---|---|---|---|
| NC_045512 | 2019 December | China | 1 |
| MT549887 | 2020 May 22 | Kenya | 2 |
| MT549878 | 2020 Mar. 17 | Kenya | 3 |
| MT547814 | 2020 Mar. 23 | USA | 4 |
| MT539729 | 2020 Apr. 23 | USA | 5 |
| MT539726 | 2020 February | Germany | 6 |
| MT539176 | 2020 May 2 | India: Vadodara | 7 |
| MT539175 | 2020 May 2 | India: Vadodara | 8 |
| MT539174 | 2020 Apr. 27 | India: Rajkot | 9 |
| MT539173 | 2020 May 2 | India: Vadodara | 10 |
| MT539172 | 2020 May 2 | India: Vadodara | 11 |
| MT539171 | 2020 May 2 | India: Vadodara | 12 |
| MT539170 | 2020 Apr. 28 | India: Rajkot | 13 |
| MT539169 | 2020 May 2 | India: Vadodara | 14 |
| MT539168 | 2020 May 2 | India: Vadodara | 15 |
| MT539167 | 2020 May 2 | India: Vadodara | 16 |
| MT539166 | 2020 May 2 | India: Vadodara | 17 |
| MT539165 | 2020 May 2 | India: Vadodara | 18 |
| MT539164 | 2020 May 2 | India: Vadodara | 19 |

*SARS-COV-2 is a RNA virus, however Table 1 lists the sequenced cDNA sequences that correspond to the RNA genome.

As used herein, the term "inactivated" refers to a vaccine comprising viral particles that do have been treated and/or modified so that they do not have disease-producing capacity. In some embodiments, an inactivated vaccine comprises viral particles that have been killed by physical and/or chemical processes.

As used herein, the term "SolaVAX" refers to a vaccine comprising SARS-CoV-2 viral particles, or fragments thereof, which have been inactivated using riboflavin and UV light as described herein. The terms "pre-SolaVAX" and "post-SolaVAX" refer to SARS-CoV-2 viral preparations before and after inactivation, respectively, using riboflavin and UV light.

When used herein to refer to an amount, the term "viral protein" refers to the total amount of viral protein measured in a vaccine preparation using, for example, a standard assay to measure protein content. The amount of SARS-CoV-2 viral protein represents all of the protein that is present in the composition form the virus including, for example, the spike protein (S-protein), the nucleocapsid protein (N-protein), envelope protein (E-protein), etc.

When used herein to refer to an adjuvant, the term "capable of promoting a Th1-type immune response" refers to those adjuvants that promote a Th1-type response over a Th2-type response. Th1-type and Th2-type immune responses are distinguished by the types of immune cells involved and the cytokines produced thereby. T helper type 1 (Th1) lymphocytes secrete interleukin (IL)-2, interferon-γ, and lymphotoxin-α and stimulate type 1 immunity, which is often characterized by intense phagocytic activity. Conversely, Th2 cells secrete IL-4, IL-5, IL-9, IL-10, and IL-13 and stimulate type 2 immunity, which is often characterized by high antibody titers. Non-limiting examples of adjuvants capable of promoting a Th1-type response over a Th2-type response include CpG and/or AS01, CpG 1018, ODN 1688, or AdVax™. AdVax™ comprises delta inulin, specifically delta inulin of highly specific particle size and morphology (See, e.g., Petrovsky, N., et al., Vaccine; 33(44): 5920-5926 (2015)). Not all adjuvants can promote a Th1-type immune response. For example, Montanide™ is one type of adjuvant that does not promote a Th1-type immune response (See, e.g., van Doorn, E., et al., Hum Vaccin Immunother; 12(1): 159-169 (2016)).

Unless the context indicates otherwise, it is specifically intended that the various features described herein can be used in any combination.

Inactivated Viral Vaccine Compositions

Provided herein are inactivated viral vaccine compositions. The compositions comprise, consist essentially of, or consist of inactivated viral particles or fragments or derivatives thereof, optionally in combination with an adjuvant. The viral particles are inactivated by modifying their DNA and/or RNA, rendering them incapable of causing disease. In some embodiments, the modification of the viral DNA and/or RNA renders the virus incapable of replicating but does not kill the virus. Because the inactivation process does not substantially alter the structure of antigens (e.g., protein and/or lipid antigens) on the viral particles, when administered to a subject in need thereof, the vaccines comprising the inactivated particles present antigenic targets to the subject's immune system that are substantially identical to those present on a pathogenic, replication-competent virus. Administration of the vaccine compositions to a subject in need thereof stimulates an immune response to the virus, therefore preventing or treating a viral infection in the subject.

In some embodiments, the inactivated viral vaccine comprises, consists essentially of, or consists of viral particles inactivated using a photochemical process to inactivate the disease-causing ability of the virus while preserving protein structure and phenotype. In some embodiments, the DNA and/or RNA of the inactivated viruses comprises modified bases. For example, in some embodiments, the DNA or RNA of the inactivated viruses may comprise modified guanine bases, such as oxidized guanine bases.

In some embodiments, the inactivated viral particles are adenovirus particles, adeno-associated virus (AAV) particles, lentivirus particles, coronavirus particles or retrovirus particles. In some embodiments, the inactivated viral particles are inactivated SARS-CoV-2 particles. In some embodiments, the viral particles are chikungunya particles, or MERS-coV particles. In some embodiments, the inactivated viral particles are African Swine Fever particles. In some embodiments, the inactivated viral particles are polio particles. In some embodiments, the inactivated viral particles are influenza particles. In some embodiments, the inactivated viral particles are Dengue, Zika, Influenza (e.g., A, B, C), Marburg, Rabies, Human Immunodeficiency Virus (HIV), Smallpox, Hantavirus, Rotavirus, SARS-CoV, MERS-CoV, Cytomegalovirus (CMV), Ebola, Epstein-Barr, Herpes (e.g., 1, 2, 6, 7, 8), Hepatitis (e.g., A, B, C, D, E), Human Papillomavirus, Mumps, Measles, Rubella, Polio, Varicella Zoster, Respiratory Syncytial Virus (RSV), Semliki Forest, West Nile, Yellow Fever, or Vesicular Stomatitis particles.

In some embodiments, an inactivated viral particle (e.g., a SARS-CoV-2 particle) comprises about 1, about 2, about 3, about 4, about 5, about 6, about 7, about 8, about 9, about 10, about 11, about 12, about 13, about 14, about 15, about 16, about 17, about 18, about 19, about 20, about 21, about 22, about 23, about 24, about 25, about 26, about 27, about 28, about 29, about 30 or more modified guanine bases, such as oxidized guanine bases, in its genome. In some embodiments, a SARS-CoV-2 particle comprises about 9 modified guanine bases in its genome. In some embodiments, a SARS-CoV-2 particle comprises about 16 modified guanine bases in its genome. In some embodiments, a SARS-CoV-2 particle comprises about 17 modified guanine bases in its genome. In some embodiments, a SARS-CoV-2 particle comprises about 18 modified guanine bases in its genome. In some embodiments, a SARS-CoV-2 particle comprises about 19 modified guanine bases in its genome. In some embodiments, a SARS-CoV-2 particle comprises about 20 modified guanine bases in its genome. In some embodiments, a SARS-CoV-2 particle comprises about 21 modified guanine bases in its genome. In some embodiments, a SARS-CoV-2 particle comprises about 22 modified guanine bases in its genome. In some embodiments, a SARS-CoV-2 particle comprises about 23 modified guanine bases in its genome. In some embodiments, a SARS-CoV-2 particle comprises about 24 modified guanine bases in its genome.

In some embodiments, the inactivated viral vaccine composition further comprises an adjuvant. The effect of the adjuvant is to boost the immunological response. In some embodiments, the adjuvant modifies monocyte function. In some embodiments, the adjuvant promotes a Th1-type response over a Th2-type response. Non-limiting examples of adjuvants capable of promoting a Th1-type response over a Th2-type response include CpG and/or AS01. In some embodiments, the adjuvant is CpG 1018. CpG 1018 (Dynavax Technologies*) is a single-stranded, 22-base pair (bp) immunostimulatory phosphorothioate oligonucleotide having a sequence 5'-TGACTGTGAACGTTCGAGATGA-3' (SEQ ID NO: 21), and a molecular mass of approximately 7150 Da. In some embodiments, the adjuvant is a single-stranded, 20-bp immunostimulatory phosphorothioate oligonucleotide having a sequence 5'-TCCATGACGTTCCT-GATGCT-3' (SEQ ID NO: 22). In some embodiments, the adjuvant is AdVax™. In some embodiments, the adjuvant comprises delta inulin. In some embodiments, the adjuvant comprises delta inulin of highly specific particle size and morphology.

Examples of suitable adjuvants include saponin formulations, virosomes, virus like particles, non-toxic derivatives of enterobacterial lipopolysaccharide (LPS), immunostimulatory oligonucleotides (e.g., an immunostimulatory oligonucleotide containing a CpG motif), mineral containing compositions, oil-emulsions, polymers, micelle-forming adjuvants (e.g., a liposome), immunostimulating complex matrices (e.g., ISCOMATRIX), particles, squalene, phosphate, cationic liposome-DNA complexes (CLDC), DDA, DNA adjuvants, gamma-insulin, ADP-ribosylating toxins, detoxified derivatives of ADP-ribosylating toxins, Freund's complete adjuvant, Freund's incomplete adjuvant, muramyl dipeptides, monophosphoryl Lipid A (MPL), poly IC, CpG oligodeoxynucleotides (ODNs), imiquimod, adjuvant system AS01, adjuvant system AS02, adjuvant system AS03, MF59® and aluminum or aluminum salts (e.g., alum, aluminum phosphate, aluminum hydroxide). In some embodiments, a CpG ODN is a class A, class B or a class C CpG ODN. In some embodiments, the CpG ODN is CPG 7909 (InvivoGen, San Diego, CA). Other suitable adjuvants include TLR agonists, NOD agonists, and lipid-DNA agonist complexes.

In some embodiments, the inactivated viral vaccine composition further comprises one or more agonists or antagonists.

In some embodiments, the agonist is a Toll-Like Receptor (TLR) agonist. In some embodiments, the TLR agonist is an agonist of one or more of TLR1, TLR2, TLR3, TLR4, TLR5, TLR6, TLR7, TLR8, TLR9, TLR10, TLR11, or TLR12. In some embodiments, the agonist is a TLR3 and/or a TLR9 agonist.

In some embodiments, the antagonist is a C-C chemokine receptor type 2 (CCR2) antagonist.

In some embodiments, the antagonist is an angiotensin receptor blocker (ARB), such as losartan, telmisartan, irbesartan, azilsartan, candesartan, eprosartan, olmesartan, or valsartan. In some embodiments, the ARB is administered at a dose of between about 5 and about 100 mg/kg, for example about 5, about 10, about 15, about 20, about 25, about 30, about 35, about 40, about 45, about 50, about 55, about 60, about 65, about 70, about 75, about 80, about 85, about 90, about 95, or about 100 mg/kg.

In some embodiments, the inactivated virus vaccine comprises at least one of (i.e., one of, two of, or all three of) a TLR agonist, a CCR2 antagonist and an ARB.

In some embodiments, the agonist or antagonist (e.g., a TLR3 and/or a TLR9 agonist) is contained within or coupled to a liposome. Liposomes are spherical, self-enclosed vesicles composed of amphipathic lipids. Liposomes may be unilamellar, having one lipid bilayer membrane, or multilamellar, having two or more concentrically arranged bilayers. Suitable liposomes may have a selected mean particle size diameter of about 200-500 nm. Various methods of preparing liposomes and encapsulation of therapeutic agents therein are well documented (see, for example, U.S. Pat. Nos. 3,932,657, 4,311,712, and 5,013,556, all of which are incorporated herein by reference). Known methods include the reverse phase evaporation method as described in U.S. Pat. No. 4,235,871, which is incorporated herein by reference.

Lipids for use in forming the liposomes described herein include vesicle-forming lipids having two hydrocarbon chains, typically acyl chains, and a polar head group. Included in this class are the phospholipids, such as phosphatidylcholine (PC), phosphatidylethanolamine (PE), phosphatidic acid (PA), phosphatidylinositol (PI), and sphingomyelin (SM), where the two hydrocarbon chains are typically between about 14-22 carbon atoms in length, and have varying degrees of unsaturation. The selection of lipids and proportions can be varied to achieve a desired degree of fluidity or rigidity, to control stability, and/or to control the rate of release of an entrapped agent. Where more than one type of lipid is used, a suitable amount of a relatively unsaturated lipid (such as PC), may be used in order to form stable liposomes. In one embodiment, at least 45-50 mol % of the lipids used to form the liposome are PC.

The liposomes may also include lipids derivatized with a hydrophilic polymer such as polyethylene glycol (PEG). Suitable hydrophilic polymers include polyvinylpyrrolidone, polyvinylmethylether, polymethyloxazoline, polyethyloxazoline, polyhydroxypropyloxazoline, polyhydroxypropylmethacrylamide, polymethacrylamide, polydimethylacrylamide, polyhydroxypropylmethacrylate, polyhydroxyethylacrylate, hydroxymethylcellulose, hydroxyethylcellulose, polyethyleneglycol, polyaspartamide, and hydrophilic peptide sequences. Methods of preparing lipids derivatized with hydrophilic polymers are known (see e.g., U.S. Pat. No. 5,395,619, which is incorporated herein by reference).

In some embodiments, the inactivated viral vaccine comprises cationic liposome-DNA complexes (CLDC).

In some embodiments, the inactivated viral vaccine further comprises a photosensitizer such as riboflavin (vitamin B2). In some embodiments, the inactivated viral vaccine is substantially free of photosensitizer.

In some embodiments, the inactivated viral vaccine composition further comprises a carrier. In some embodiments, the cells and/or the photosensitizer are suspended in the carrier. In some embodiments, the carrier comprises normal saline (e.g., 0.9% sodium chloride), dextrose saline (e.g., dextrose 5% in 0.9% sodium chloride), phosphate buffered saline (e.g., 137 mmol/L NaCl, 2.7 mmol/L KCl, 10 mmol/L $Na_2HPO_4$, 2 mmol/L $KH_2PO_4$).

In some embodiments, the inactivated viral vaccine composition further comprises one or more additional pharmaceutically acceptable ingredients well known to those skilled in the art, including, but not limited to, pharmaceutically acceptable carriers, diluents, excipients, adjuvants, fillers, buffers, preservatives, anti-oxidants, lubricants, stabilizers, solubilizers, surfactants (e.g., wetting agents), masking agents, coloring agents, flavoring agents, and sweetening agents. Suitable carriers, diluents, excipients, etc. can be found in standard pharmaceutical texts. See, for example, *Handbook of Pharmaceutical Additives,* 2nd Edition (eds. M. Ash and I. Ash), 2001 (Synapse Information Resources, Inc., Endicott, New York, USA), *Remington's Pharmaceutical Sciences,* 20th edition, pub. Lippincott, Williams & Wilkins, 2000; and *Handbook of Pharmaceutical Excipients,* 2nd edition, 1994.

In some embodiments, a vaccine composition comprises an inactivated SARS-CoV-2 viral particle; wherein the composition comprises about 15 to about 50 picograms of viral protein (e.g., about 35 picograms of viral protein) and an adjuvant; and wherein the adjuvant is a phosphorothioate oligonucleotide comprising about 15 to about 30 nucleotides.

In some embodiments, a vaccine composition comprises an inactivated SARS-CoV-2 viral particle; wherein the genome of the SARS-CoV-2 viral particle comprises about 1 to about 30 oxidized guanine residues (e.g., about 9 or about 20 oxidized guanine residues); wherein the structure of antigens on the viral particle is not substantially altered compared to SARS-CoV-2 viral particle that has not been inactivated.

In some embodiments, a vaccine composition comprises inactivated SARS-CoV-2 viral particles from multiple SARS-CoV-2 strains. For example, in some embodiments, a vaccine composition comprises an inactivated SARS-CoV-2 particle from a first strain, and a second inactivated SARS-CoV-2 particle from a separate strain. In some embodiments, a vaccine composition comprises inactivated SARS-CoV-2 particles from at least two, at least three, at least four, at least five, at least six, at least seven, at least eight, at least nine, or at least ten different SARS-CoV-2 strains.

Methods of Producing Inactivated Viral Vaccines

The inactivated viral vaccines described herein are produced using an innocuous chemical agent in a selective process that prevents cellular replication processes while preserving antigenic protein structure. More specifically, the inactivated viral vaccines are produced by the combined application of a photosensitizer and light for rendering viral particles unable to cause disease. The process for producing the inactivated viral vaccines of the disclosure is described in detail below.

Initially, viral particles are provided. The viral particles may be recombinant viral particles.

Next, the viral particles are inactivated using photochemical technology. This is achieved using photosensitizers that can act as electron transfer agents. The application of photosensitizer agents that can be placed into an excited state in proximity to a guanine base in DNA or RNA constructs allows for selective modification (e.g. oxidation, cross-linking, fragmentation, deamination) of these bases. Because electron chemistry can only occur over short distances, the photosensitizer agent must be bound or associated with (i.e., intercalated with) the nucleic acid in order to carry out the desired chemistry.

In some embodiments, the photosensitizer is a flavin, for example riboflavin (Vitamin B2), flavin mononucleotide, or flavin adenine dinucleotide. In some embodiments, the photosensitizer is a tertiary aliphatic amine (e.g., 1,4-diazabicyclo(2,2,2)octane), a piperazine, (e.g., N-2-hydroxyethylpiperazine-N'-2-ethanesulfonic acid and 1,4-dimethylpiperazine), an amino acid (e.g., tyrosine, tryptophan, histidine, methionine), an enzyme (e.g., superoxide dismutase) or EDTA (ethylenediaminetetraacetic acid). In some embodiments, the photosensitizer is riboflavin.

In some embodiments, the viral particles are added to a solution containing the photosensitizer (e.g., riboflavin), or the photosensitizer is added to a solution containing the viral particles.

In some embodiments, the concentration of photosensitizer used during inactivation is about 10 μM to about 100 μM, such as about 10 μM, about 15 μM, about 20 μM, about 25 μM, about 30 μM, about 35 μM, about 40 μM, about 45 μM, about 50 μM, about 55 μM, about 60 μM, about 65 μM, about 70 μM, about 75 μM, about 80 μM, about 85 μM, about 90 μM, about 95 μM, about 100 μM, about 200 μM, about 300 μM, about 500 μM, or more. In some embodiments, the solution contains the photosensitizer at a concentration of about 1 μM to about 50 μM, such as about 2 μM, about 3 μM, about 4 μM, about 5 μM, about 6 μM, about 7 μM, about 8 μM, about 9 μM, about 10 μM, about 15 μM, about 20 μM, about 25 μM, about 30 μM, about 35 μM, about 40 μM, about 45 μM, about 50 μM, about 100 μM, about 200 μM, about 300 μM, about 500 μM, or more. In some embodiments, the photosensitizer concentration is less than about 10 μM, such as less than about 9 μM, about 8 μM, about 7 μM, about 6 μM, about 5 μM, about 4 μM, about 3 μM, about 2 μM, or about 1 μM.

The solution containing the photosensitizer and the viral particles (optionally, in media) is then subjected to light treatment. In some embodiments, the light treatment comprises treatment with visible light, ultraviolet light, and/or infrared light. The light treatment inactivates a nucleic acid (e.g., DNA and/or RNA) in the viral particles by modifying bases of these nucleic acids. In some embodiments, guanine bases are selectively modified. In some embodiments, guanine bases are selectively oxidized. Oxidized guanine bases cannot be repaired by natural enzymatic and cell repair mechanisms. As such, there is no possibility for reversion of the induced change to a form that would restore the ability of the viral particles to cause disease.

In some embodiments, the light treatment comprises treatment with ultraviolet (UV) light. The UV light may be UV-A, UV-B, or UV-C light. The UV light may have a wavelength of 170 to 400 nm, including all ranges and subranges therebetween. For example, in some embodiments, the UV light has a wavelength of 315 to 400 nm, 310 to 320 nm, 280 to 360 nm, 280 to 315 nm, or 180 to 280 nm. The UV light may be provided by UV light sources known in the art, such as the Mirasol® PRT Illumination device (TerumoBCT, Lakewood, Colorado). In some embodiments, the viral particles may be treated with multiple wavelengths of light simultaneously.

In some embodiments wherein riboflavin is used as a photosensitizer, UV light having a wavelength of 310 to 320 nm is used. The inventors have determined that this wavelength prevents riboflavin from reacting in free solution, which results in production of undesirable oxygen free radicals. At these wavelengths, riboflavin will selectively react when intercalated with nucleic acid.

The dose of the UV light may vary depending on the volume of solution being treated. For example, the dose of the UV light may be between 200-400 Joules (e.g., 300 Joules) for a volume of about 170 to 370 mls of solution. As will be understood by those of skill in the art, the dosage may be adjusted up or down if the volume to be treated is above or below this range.

In some embodiments, the dose of UV light may be from about 200 Joules to about 600 Joules, for example about 200, about 225, about 250, about 275, about 300, about 325, about 350, about 375, about 400, about 425, about 450, about 475, about 500, about 525, about 550, about 575, or about 600 Joules. In some embodiments, the volume of viral preparations for illumination may be from about 200 ml to about 600 ml, for example about 200, about 225, about 250, about 275, about 300, about 325, about 350, about 375, about 400, about 425, about 450, about 475, about 500, about 525, about 550, about 575, or about 600 ml. In some embodiments, the dose of UV light may be from about 0.01 Joules/ml to about 1.0 Joules/ml. In some embodiments, the dose of UV light may be from about 0.5 Joules/ml to about 3.0 Joules/ml. For example, the dose of UV light may be about 0.1, about 0.2 about 0.3, about 0.4, about 0.5, about 0.6, about 0.7, about 0.8, about 0.9, about 1.0, about 1.1, about 1.2, about 1.3, about 1.4, about 1.5, about 1.6, about 1.7, about 1.8, about 1.9, about 2.0, about 2.1, about 2.2, about 2.3, about 2.4, about 2.5, about 2.6, about 2.7, about 2.8, about 2.9, or about 3.0 Joules/ml. In some embodiments, the dose of UV light may be about 0.1 Joules/ml. In some embodiments, the dose of UV light may be from about 1 Joules/ml to about 10 Joules/ml, such as about 1.87 Joules/ml, about 3.74 Joules/ml, or about 6.24 Joules/ml.

The viral particles may be treated with UV light for about 1 minute to about 60 minutes, for example, about 1, about 2, about 3, about 4, about 5, about 6, about 7, about 8, about 9, about 10, about 15, about 20, about 25, about 30, about 35, about 40, about 45, about 50, about 55, or about 60 minutes. In some embodiments, the viral particles are treated with UV light for about 1 minute to about 10 minutes, about 1 minute to about 5 minutes, or about 1 minute to about 3 minutes.

In some embodiments, the viral particles are pre-incubated for a predetermined period of time in the solution containing the photosensitizer (e.g., riboflavin) before subjecting the viral particles to the light treatment.

In some embodiments, the viral particles are not subjected to any additional purification or modification steps after light treatment. In other embodiments, the viral particles are purified after the light treatment. In some embodiments, the viral particles are concentrated after the light treatment.

In some embodiments, the viral particles are combined with one or more additional pharmaceutically acceptable ingredients as described above after light treatment. In some embodiments, the viral particles are combined with a solution comprising an adjuvant after light treatment.

In some embodiments, the viral particles generated using this method are incapable of replication processes, but substantially maintain and preserve the antigen and epitope profile of the original, native viral particle or antigen. In some embodiments, the inactivation process does not substantially change the phenotype or structure of the viral particles.

In some embodiments, because the specificity of the chemistry preserves the antigen profile and viral particle integrity, and maintains viral protein and/or lipid structure in its native state, the inactivated viral particles that are produced by this process provide an improved source for antigen presentation.

In some embodiments, a method for inactivating a SARS-CoV-2 viral particle comprises contacting the SARS-CoV-2 viral particle with a dose of UV light in the presence of riboflavin; wherein the dose of UV light is about 100 Joules to about 1000 Joules; wherein the method comprises selectively oxidizing about 1 to about 30 guanine bases (e.g., about 9 or about 30 guanine bases) in a nucleic acid (e.g., an RNA or a DNA) of the viral particle; and wherein the method does not comprise substantially altering the structure of antigens on the viral particle.

Methods of Treatment

The inactivated viral vaccine compositions described herein can be used as vaccine agents or stimulants for immune system priming and recognition that foster immune responses in subjects.

In some embodiments, the inactivated viral vaccine may be administered to a subject to treat or prevent a viral infection, such as a SARS-CoV-2 infection.

In some embodiments, the subject is assessed for immune function and immune status prior to administration of the vaccine. Such assessments may include, but are not limited to, DTH skin testing, blood tests, lymph node aspirate tests, tumor tissue tests, and/or determination of whether the subject is anergic, B cell responsive, etc. In some embodiments, the subject is not assessed for immune function and immune status prior to administration of the vaccine.

In some embodiments, the subject is immunocompetent. In some embodiments, the subject is immunocompromised. Optionally, the vaccine may be used in combination with genetic testing to quantify the degree of immune-responders, or immune non-responders.

It will be appreciated by one of skill in the art that appropriate number of viral particles in the vaccine composition can vary. In some embodiments, the vaccine composition comprises about $1 \times 10^3$, about $1 \times 10^4$, about $1 \times 10^5$, about $1 \times 10^6$, about $1 \times 10^7$, about $1 \times 10^8$, about $1 \times 10^9$, or about $1 \times 10^{10}$ viral particles. In some embodiments, a vaccine composition comprises about $1 \times 10^5$ to about $1 \times 10^8$ viral particles.

In some embodiments, a vaccine dose further comprises an adjuvant. In some embodiments the adjuvant is CpG. In some embodiments, the CpG is CpG 7909. In some embodiments, a vaccine dose comprises from about 25 µg to about 750 µg CpG, or from about 50 µg to about 500 µg CpG. In some embodiments, a vaccine dose comprises about 50 µg or about 500 µg CpG. In some embodiments, the adjuvant is CpG 1018. In some embodiments, a vaccine dose comprises from about 25 µg to about 750 µg CpG 1018, or from about 50 µg to about 500 µg CpG 1018. In some embodiments, a vaccine dose comprises about 50 µg or about 500 µg CpG 1018. In some embodiments the adjuvant is ODN 1668. In some embodiments, a vaccine dose comprises from about 25 µg to about 750 µg ODN 1668, or from about 50 µg to about 500 µg ODN 1668. In some embodiments, a vaccine dose comprises about 50 µg or about 500 µg ODN 1668.

In some embodiments, about $1 \times 10^5$ to about $1 \times 10^8$ viral particles are administered to a subject in each administration. For example, about $1\times10^5$, about $5\times10^5$, about $1\times10^6$, about $5\times10^6$, about $1\times10^7$, about $5\times10^7$, or about $1\times10^8$ viral particles may be administered to a subject per administration. In some embodiments, the administered dose is a split dose, wherein the total number of viral particles for administration is divided into 2, 3, 4, 5, 6, 7, 8, 9, or 10 sub-doses.

In some embodiments, about 10 to about 100 micrograms of viral protein are administered to a subject in each administration. In some embodiments, about 1 to about 100 picograms of viral protein are administered to a subject in each administration. In some embodiments, about 15 to about 50 picograms, or about 30 to about 40 picograms of viral protein are administered to a subject in each administration. For example, about 5, about 10, about 15, about 20, about 25, about 30, about 35, about 40, about 45, about 50, about 55, about 60, about 65, about 70, about 75, about 80, about 85, about 90, about 95, or about 100 picograms of viral protein may be administered to a subject in each administration. In some embodiments, about 10 picograms of viral protein are administered to a subject in each administration. In some embodiments, about 11 picograms of viral protein are administered to a subject in each administration. In some embodiments, about 12 picograms of viral protein are administered to a subject in each administration. In some embodiments, about 13 picograms of viral protein are administered to a subject in each administration. In some embodiments, about 14 picograms of viral protein are administered to a subject in each administration. In some embodiments, about 15 picograms of viral protein are administered to a subject in each administration. In some embodiments, about 16 picograms of viral protein are administered to a subject in each administration. In some embodiments, about 17 picograms of viral protein are administered to a subject in each administration. In some embodiments, about 35 picograms of viral protein are administered to a subject in each administration. In some embodiments, the administered dose is a split dose, wherein the total amount of viral protein for administration is divided into 2, 3, 4, 5, 6, 7, 8, 9, or 10 sub-doses.

One or more sub-dose may be administered to the subject peripherally, at different locations on the subject's body. Each sub-dose may be administered at approximately the same time, or administration of the sub-doses may be staggered. For example, sub-doses may be administered at intervals of 15 minutes, 20 minutes, 30 minutes, 45 minutes, 1 hour, or 3 hours.

In some embodiments, the inactivated viral vaccine is administered once, or more than once to the subject. In some embodiments, the vaccine is administered once, twice, three times, four times, five times, six times, seven times, eight times, nine times, or ten times to the subject.

The inactivated viral vaccine may be administered to the subject every day, about every 3 days, about every 7 days, about every fourteen days, about once per month, or about once per year. In some embodiments, the vaccine is administered at least once per week, at least every two weeks, or at least once every six months. In some embodiments, the vaccine is administered once, twice, three times, four times, five times, six times, seven times, eight times, nine times, ten times, twelve times, fifteen times, twenty times, or twenty-five times in a year.

In some embodiments, a first dose (e.g., a prime dose) of inactivated viral vaccine is administered, followed by a second dose (e.g., a boost dose) to the subject. In some embodiments, the second dose is administered about 1 week, about 2 weeks, about 3 weeks, about 4 weeks, about 2 months, about 3 months, about 4 months, about 5 months, about 6 months, or about 1 year after the first dose. In some embodiments, the amount of viral protein in the first dose is greater than the amount of viral protein in the second dose. For example, the amount of viral protein may be about 10%, about 20%, about 30%, about 40%, about 50%, about 60%, about 70%, about 80%, about 90%, or about 100% greater than the amount of viral protein in the first dose. In some embodiments, the amount of viral protein in the first dose is less than the amount of viral protein in the second dose. For example, the amount of viral protein may be about 10%, about 20%, about 30%, about 40%, about 50%, about 60%, about 70%, about 80%, about 90%, or about 100% less than the amount of viral protein in the first dose. In some embodiments, the amount of viral protein in the first dose is about the same as the amount of viral protein in the second dose.

In some embodiments, a first inactivated viral vaccine and a second inactivated viral vaccine are administered to the subject. In some embodiments, the second inactivated viral vaccine is administered after the first vaccine to boost the immune response. In some embodiments, immune response in the subject is monitored between administration of the first vaccine and the second vaccine. In some embodiments, the second vaccine is administered when it is determined that the subject has not exhibited a satisfactory immune response following administration of the first vaccine.

The inactivated viral vaccine may be delivered to the subject intramuscularly, intramucosally, intranasally, subcutaneously, intratumorally, intradermally, transdermally, intravaginally, intraperitoneally, intrarectally, intra-articularly or intra-lymphatically, orally or intravenously. In some embodiments, administration may be by sublingual, buccal, intra-organ (e.g., intrasplenic), or inhaled routes. For intravenous, cutaneous or subcutaneous injection, or injection at the site of an infection, the vaccine composition may be in the form of a parenterally acceptable aqueous solution which has suitable pH, isotonicity and stability. Those of relevant skill in the art are well able to prepare suitable solutions using, for example, isotonic vehicles such as Sodium Chloride Injection, Ringer's Injection, or Lactated Ringer's Injection. Preservatives, stabilizers, buffers, antioxidants and/or other additives may be included, as required.

In some embodiments, the vaccine is administered peripherally to the subject. In some embodiments, multiple aliquots of the vaccine are administered peripherally to the subject, in different locations.

In some embodiments, the vaccine is administered simultaneously or sequentially (either before or after) with a vaccine-enhancing agent. In some embodiments, the vaccine-enhancing agent is an angiotensin receptor blocker (ARB) or a beta blocker (BB). Exemplary vaccine-enhancing agents include losartan, telmisartan, irbesartan, azilsartan, candesartan, eprosartan, olmesartan, valsartan, propranolol, acebutolol, atenolol, betaxolol, bisoprolol, carteolol, carvedilol, esmolol, labetalol, metoprolol, nadolol, nebivolol, penbutolol, pindolol, propranolol, sotalol, timolol. In some embodiments, the vaccine-enhancing agent is selected from the group consisting of losartan and propranolol. In some embodiments, the vaccine-enhancing agent is losartan. In some embodiments, the vaccine-enhancing agent is propranolol.

In some embodiments, a method for vaccinating a subject comprises administering an inactivated viral vaccine composition comprising inactivated viral particles, and a potent adjuvant comprising TLR3 and/or TLR9 agonists attached to liposomes, and also comprises sequential or simultaneous administration of a vaccine-enhancing agent (e.g., losartan), which is given at or around the time of vaccination and reduces recruitment of immune suppressive myeloid cells.

In some embodiments, a method for vaccinating a subject comprises administering an inactivated viral vaccine composition comprising inactivated viral particles to a subject in need thereof. An adjuvant may optionally be administered at the time of vaccination. In some embodiments, an adjuvant is administered after vaccination to boost the immune response, for example about 6 hours, about 12 hours, about 24 hours, about 36 hours, about 48 hours, about 60 hours, or about 72 hours after vaccination. In some embodiments, the adjuvant comprises liposomes, e.g., CLDC. In some embodiments, a vaccine-enhancing agent such as losartan may be administered at or around the time of the vaccination. In some embodiments, a vaccine-enhancing agent such as losartan may be administered after vaccination, for example, about 6 hours, about 12 hours, about 24 hours, about 36 hours, about 48 hours, about 60 hours, or about 72 hours after vaccination. In some embodiments, a vaccine-enhancing agent such as losartan may be administered to the subject daily for an effective number of days, optionally beginning on the day that the vaccine is administered. In some embodiments, the vaccine-enhancing agent (e.g., losartan) is administered at a dose of between about 5 and about 100 mg/kg, for example about 5, about 10, about 15, about 20, about 25, about 30, about 35, about 40, about 45, about 50, about 55, about 60, about 65, about 70, about 75, about 80, about 85, about 90, about 95, or about 100 mg/kg.

The inactivated viral vaccine may elicit an immune response in the subject. In some embodiments, the immune response may include one or more of the following: (i) upregulation of immunoglobulin expression (e.g., IgG, IgM), (ii) T-cell activation, (iii) modulation of innate immune cells (e.g., myeloid cells), and (iv) revival of "exhausted" T-Cell populations.

Suitable subjects include both avians and mammals. The term "avian" as used herein includes, but is not limited to, chickens, ducks, geese, quail, turkeys, pheasant, parrots, parakeets, and the like. The term "mammals" as used herein includes, but is not limited to, humans, non-human primates, bovines, ovines, caprines, equines, felines, canines, lagomorphs, etc. Human subjects include neonates, infants, juveniles, adults and geriatric subjects.

Diagnostic Methods

In diagnostic development, the goal is to have an accurate test to detect a target of interest, whether that be a nucleic acid, antigen, or antibody. Several serological assays have been developed that use the pathogen (e.g., the viral particle) as an antigen to detect the present of antibodies against that pathogen in the host. Serological assays are important for the detection of antibodies against pathogens in the host. These assays provide information on previous exposure to an antigen and are used for the surveillance and prevalence of a pathogen within a population. A common serological platform is to use antigen from the pathogen to detect the presence of antibodies.

The key to success with such approaches resides in the ability to balance the alterations required for antigen production with the preservation of key antigen epitopes similar to the native pathogen and maintain high diagnostic accuracy. Candidates produced by such a method would possess the native protein structures that are as close to natural structures in the intact pathogen as possible. The production of inactivated pathogen antigens uses methods such as heat and formalin but the harsh treatments can lead to damage to key epitopes for antibody binding. Antigens are also produced using a bacterial system where specific antigens from the pathogen are recombinantly produced. These antigens are commonly pieces of the pathogen as opposed to the whole pathogen. Using smaller, more specific antigens allow for the detection of specific antibodies but does not allow the detection of multiple antibody subtypes and therefore reduced assay sensitivity. Moreover, these recombinant antigens are laborious and time consuming to produce. The technique typically requires specialized skill set and equipment.

Provided herein is a method for producing whole pathogen antigen (i.e., inactivated viral particles) for use in a diagnostic assay, using a combination of UV light and riboflavin. The UV and riboflavin methodology utilizes whole pathogen for increased antibody attachment and the production process is much shorter. Additionally the method is safe and does not need harsh inactivation methods or sophisticated equipment for production. The method can be used to rapidly develop indirect or capture format serological assay like ELISAs, lateral flow tests, and western blots. The method can be used with existing serological assays to improve sensitivity and reduce assay cost. Or it can be used for new assay development especially with newer multiplexing technologies. Lastly, the ease and low cost to produce inactivated antigen makes it useful in lower-income areas where the need for sensitive yet affordable diagnostic tests is in critical need.

Thus, in some embodiments, viral particles inactivated according to the methods disclosed herein may be used in diagnostic compositions and methods. For example, the inactivated viral particles may be used to detect the presence of an anti-viral antibody (e.g., a neutralizing antibody) in a biological sample. The biological sample may be, for example, blood (e.g., whole blood, serum, or plasma), stool, urine, saliva, or swab specimens of the nostril, throat, cervix, or urethra. Because intact viral particles are used, antibodies that bind to many different targets (i.e., different viral epitopes) may be detected using a single assay.

In some embodiments, an inactivated viral particle (e.g., a SARS-CoV-2 viral particle) is coupled to and/or immobilized on a substrate. The substrate may be biological, non-biological, organic, inorganic, or a combination of any of these, existing as particles, strands, precipitates, gels, sheets, tubing, spheres, containers, capillaries, pads, slices, films, plates, slides, etc. The substrate may have any convenient shape, such as a disc, square, sphere, and a circle. The substrate may, in some embodiments, form a rigid support. In some embodiments, the substrate and its surface may be chosen to provide appropriate light-absorbing characteristics. For instance, the substrate may be a polymerized Langmuir Blodgett film, functionalized glass, Si, Ge, GaAs, GaP, $SiO_2$, $SiN_4$, modified silicon, or any one of a wide variety of polymers such as (poly)tetrafluoroethylene, (poly) vinylidenedifluoride, or combinations thereof. In some embodiments, the substrate may be a bead, a resin, a membrane, a fiber, a polymer, a matrix, a chip, a microplate or a tissue culture vessel.

In some embodiments, the substrate is pre-treated before the inactivated viral particle is coupled thereto. For example, the substrate may be treated with an enzyme, such as a DNAse, RNAse or protease. In some embodiments, the substrate may be coated with a polymer or a carbohydrate. In some embodiments, the substrate may be coated with a protein, such as an antibody, antibody fragment (e.g., Fab), or antibody derivative (e.g., a single chain variable fragment (scFv)).

The inactivated viral particle (e.g., the inactivated SARS-CoV-2 viral particle) may be coupled to the substrate using various different methods. For example, the inactivated viral particle may be reversibly or irreversibly coupled to the substrate. In some embodiments, the inactivated viral particle is coupled to the substrate via a linker. The linker may be a chemical or a protein linker. The chemical linker may be, for example, a carbohydrate linker, a polyether linker, a fatty acid linker, or a lipid linker. In some embodiments, the protein linker may comprise about 1 to about 50 amino acids. In some embodiments, the protein linker is a flexible linker (i.e., a linker that comprises small polar amino acids, including threonine, serine, and/or glycine). In some embodiments, the protein linker is not flexible (i.e., a linker that comprises one or more proline residues).

In some embodiments, the inactivated viral particles described herein may be used in a method for detecting the presence of an antibody in a biological sample. The antibody may be an antibody that binds to the viral particle (e.g., a SARS-CoV-2 viral particle), such as a neutralizing antibody. In some embodiments, the method for detecting an antibody in a biological sample comprises contacting the biological sample with a virus particle (e.g., a SARS-CoV-2 particle) that is coupled to a substrate. In some embodiments, the antibody binds to the virus particle that is coupled to the substrate, thereby immobilizing the antibody. In some embodiments, the method further comprises contacting the immobilized antibody with a second antibody, such as a detection antibody. The detection antibody may be coupled to, for example, a fluorophore, or to an enzyme (e.g., horseradish peroxidase (HRP)) capable of cleaving a substrate (e.g., a fluorescent substrate).

In some embodiments, the inactivated viral particles described herein may be used in an ELISA-based assay. An ELISA (enzyme-linked immunosorbent assay) is a plate-based assay technique designed for detecting and quantifying proteins, such as antibodies, in a biological sample. In an ELISA, an antigen (e.g., an inactivated viral particle) is typically immobilized to a solid surface and then complexed with an antibody that is linked to an enzyme. Detection may be accomplished by measuring the activity of the reporter enzyme via incubation with the appropriate substrate to produce a measurable product. There are several different types of ELISAs commonly used, including direct ELISAs, indirect ELISAs, sandwich ELISAs, and competitive ELISAs.

In some embodiments, an inactivated SARS-CoV-2 particle is coupled to a substrate. The SARS-CoV-2 particle is contacted with a biological sample comprising an antibody that binds to the SARS-CoV-2 particle. A complex is formed between the antibody and to the virus particle that is coupled to the substrate, thereby immobilizing the antibody. After the biological sample (including any unbound antibodies) is washed away, the antibody is contacted with a detection antibody. The binding of the antibody to the SARS-CoV-2 particle is measured, for example, by detecting the amount of detection antibody bound. In some embodiments wherein the detection antibody is conjugated to an enzyme (e.g., an HRP), binding of the antibody to the SARS-CoV-2 particle may be measured by measuring the amount of a fluorophore produced when an appropriate substrate is added to the sample.

The emergence and rapid spread of SARS-CoV-2 demonstrated our inability to rapidly respond to pandemic pathogens. The development for sensitive diagnostic assays in a rapid manner is critical for stopping the spread of a pandemic pathogen. Accordingly, the diagnostic compositions and methods described herein are helpful for use in pandemic situations. Moreover, the methods are not specific to a particular pathogen and can be applied to any pathogen that may emerge in the future. In some embodiments, these methods can be deployed for the next pandemic pathogen, pathogen "X".

Immunogenic Compositions Comprising Inactivated Viral Particles

Convalescent plasma therapy has long been used to treat or prevent viral and other infections. This therapy has been used against novel viruses that spread through communities with no natural immunity, where there are survivors, and where no vaccine and no effective antiviral treatment is available. Convalescent plasma therapy was first described during the 1918 Spanish Influenza (H1N1) pandemic, and has since been used to treat diphtheria, measles, SARS, MERS, and Ebola.

Convalescent plasma therapy involves obtaining plasma from a first subject that has recovered from a viral or other infection (i.e., a convalescent subject). The first subject's plasma presumably contains antibodies against the virus or other pathogenic agent. Subsequently, the first subject's plasma is administered to a second subject, in order to treat or prevent infection in the second subject.

Several clinical studies have reported success using convalescent plasma therapy to treat or prevent various infections, but such data is often hard to interpret. Moreover, there are several issues which prevent widespread use of such therapy. For example, plasma obtained from each convalescent subject will contain a different titer of antibodies, and may have different neutralizing potential. Therefore, it is difficult to predict a priori if a particular convalescent subject's plasma will be effective when administered to a second subject. Additionally, the availability of convalescent plasma is limited by the number of convalescent subjects. During large pandemics or other periods of high demand, there may not be enough convalescent plasma to treat all subjects in need thereof.

There is a need in the art for improved therapies that overcome the limitations of convalescent plasma therapy. Specifically, there is a need in the art for improved methods for producing antibodies against one or more viruses or other pathogens, and use thereof to treat or prevent disease in a subject.

The inactivated viral particles described herein may be used in immunogenic compositions, to provoke an antibody response when administered to a host. The antibodies may then be recovered from the host, and administered to subject in need thereof in order to treat or prevent a disease or disorder in the subject. In some embodiments, the compositions and methods described herein are used to treat or prevent infection with severe acute respiratory syndrome coronavirus 2 (SARS-CoV-2), the virus responsible for COVID-19, in a subject in need thereof. In some embodiments, the compositions and methods described herein may be used for convalescent plasma therapy.

In some embodiments, an immunogenic composition comprises a polyclonal antibody that binds to a viral particle, wherein the polyclonal antibody is produced by administering to a host an inactivated viral particle, wherein the inactivation is performed by contacting the viral particle with a dose of UV light in the presence of riboflavin. In some embodiments, the dose of UV light is about 100 Joules to about 1000 Joules. In some embodiments, the dose of UV light is about 100 Joules.

In some embodiments, the viral particle is an adenovirus particle, an adeno-associated virus (AAV) particle, a lentivirus particle, a coronavirus particle, or a retrovirus particle. In some embodiments, the viral particle is a SARS-CoV-2 particle. In some embodiments, the viral particle is a Dengue, Zika, African Swine Fever, Influenza, Marburg, Rabies, Human Immunodeficiency Virus (HIV), Smallpox, Hantavirus, Rotavirus, SARS-CoV, MERS-CoV, Cytomegalovirus (CMV), Ebola, Epstein-Barr, Herpes, Hepatitis, Human Papillomavirus, Mumps, Measles, Rubella, Polio, Varicella Zoster, Respiratory Syncytial Virus (RSV), Semliki Forest, West Nile, Yellow Fever, or Vesicular Stomatitis particle.

In some embodiments, a nucleic acid of the viral particle comprises one or more modifications. The nucleic acid may be, for example, a DNA or an RNA. In some embodiments, the nucleic acid of the viral particle comprises oxidized guanine bases. In some embodiments, the nucleic acid comprises about 1 to about 30 oxidized guanine bases. In some embodiments, the inactivated viral particle is not capable of replicating in a cell. In some embodiments, the inactivated viral particle is not capable of causing disease in a subject.

In some embodiments, the composition comprises an adjuvant. In some embodiments, the adjuvant is capable of promoting a Th1-type response. In some embodiments, the composition comprises a pharmaceutically acceptable carrier or excipient.

In some embodiments, the host is a mammal. In some embodiments, the host is a non-human primate, a bovine, an ovine, a caprine, an equine, a feline, a canine, a rodent or a lagomorph. In some embodiments, the host is a human. In some embodiments, the host is an avian. In some embodiments, the host is a chicken, a duck, a goose, a quail, a turkey, a pheasant, a parrot, or a parakeet.

Also provided here in are methods for treating or preventing a disease or disorder in a subject in need thereof, the method comprising administering to a subject in need thereof an effective amount of an immunogenic composition as described herein. In some embodiments, the inactivated viral particle is SARS-CoV-2, and the disease or disorder is COVID-19.

In some embodiments, the immunogenic composition is administered intravenously to the subject. In some embodiments, the immunogenic composition is administered intramuscularly to the subject. In some embodiments, the subject is a human.

In some embodiments, a method of producing a polyclonal antibody that binds to a viral particle comprises generating an inactivated viral particle by contacting the viral particle with a dose of UV light in the presence of riboflavin; administering the inactivated viral particle to a host, wherein the host produces a polyclonal antibody; and recovering the polyclonal antibody. In some embodiments, the viral particle is a SARS-CoV-2 particle.

In some embodiments, the host is a chicken, and the polyclonal antibody is recovered from an egg produced by the host. n some embodiments, the polyclonal antibody is recovered from the blood of the host. In some embodiments, the polyclonal antibody is recovered from B cells of the host.

Also provided are polyclonal antibodies produced by the methods described herein.

Also provided are methods for treating or preventing a disease or disorder in a subject in need thereof, the method comprising administering to a subject in need thereof an effective amount of a polyclonal antibody described herein.

Also provided are methods for detecting the presence of a viral particle in a subject in need thereof, the method comprising contacting a biological sample of the subject with a polyclonal antibody as described herein; and detecting binding between the polyclonal antibody and the viral particle. In some embodiments, the viral particle is a SARS-CoV-2 particle.

In some embodiments, the biological sample is whole blood, serum, plasma, urine, saliva, lymph fluid, bile, cerebrospinal fluid, nasal mucus, or stool.

In some embodiments, the polyclonal antibody is conjugated to a substrate. In some embodiments, the substrate is a bead, a chip, a slide or a dish.

In some embodiments, the detecting step comprises contacting the polyclonal antibody with a secondary antibody that is conjugated to an enzyme or to a fluorophore.

Methods for Producing Polyclonal Antibodies in a Host

The compositions described herein, including the immunogenic compositions, can be used to provoke an immune response in a host. In some embodiments, a composition comprising an inactivated viral particle or other inactivated pathogen is administered to a host, in order to provoke an immune response in the host. The immune response may comprise, for example, production of antibodies against various different antigens on the inactivated viral particle or other inactivated pathogen.

As used herein, the term "polyclonal antibodies" refers to antibodies that are secreted by different B cell lineages. In contrast, a monoclonal antibody comes from a single-cell lineage. A polyclonal antibody comprises a collection of immunoglobulin molecules that react against a specific antigen, each identifying a different epitope. Typically, when a viral particle or other pathogenic particle is administered to a host, the host produces a polyclonal antibody against the particle that was administered. The polyclonal antibody will typically include a mixture of antibodies produced by different B cell lineages, and each antibody may identify a different epitope.

In some embodiments, a method of producing a polyclonal antibody that binds to a viral particle comprises i) generating an inactivated viral particle by contacting the viral particle with a dose of UV light in the presence of riboflavin; ii) administering the inactivated viral particle to a host, wherein the host produces a polyclonal antibody; and iii) recovering the polyclonal antibody. In some embodiments, the viral particle is a SARS-CoV-2 particle.

In some embodiments, a method of producing a polyclonal antibody that binds to a pathogen (e.g., a non-viral pathogen) comprises i) generating an inactivated pathogen particle by contacting the particle with a dose of UV light in the presence of riboflavin; ii) administering the inactivated particle to a host, wherein the host produces a polyclonal antibody; and iii) recovering the polyclonal antibody.

The inactivated viral particle or other pathogenic particle may be administered to the host by standard methods used in the art. For example, the inactivated particle may be administered intramuscularly, intramucosally, intranasally, subcutaneously, intratumorally, intradermally, transdermally, intravaginally, intraperitoneally, intrarectally, intraarticularly or intra-lymphatically, orally or intravenously.

In some embodiments, the methods comprise administering an adjuvant to the host. Acceptable adjuvants are listed above, including adjuvants that promote a Th1-type response.

In some embodiments, the host is a mammal. In some embodiments, the host is a non-human primate, a bovine, an ovine, a caprine, an equine, a feline, a canine, a rodent or a lagomorph. The rodent may be, for example, a mouse, a rat, a guinea pig, or a hamster. In some embodiments, the host is a human. In some embodiments, the host is an avian. In some embodiments, the host is a chicken, a duck, a goose, a quail, a turkey, a pheasant, a parrot, or a parakeet.

The polyclonal antibody may be recovered from a host in numerous different ways. For example, a blood sample (e.g., whole blood, serum, or plasma) containing the polyclonal antibody may be recovered from the host. In some embodiments, the antibody may be recovered from an immune cell producing an antibody (e.g., a B-cell) that is obtained from the host. In some embodiments, the antibody may be recovered from biological material produced by the host. For example, antibodies may be recovered from an egg (e.g., a chicken egg) produced by the host. In some embodiments, the antibodies may be isolated or purified after they are recovered from the host. In some embodiments, the antibodies are not isolated or purified after they are recovered from the host.

In some embodiments, the host is a chicken, and the polyclonal antibody is recovered from an egg produced by the host. In some embodiments, the polyclonal antibody is recovered from the blood of the host. In some embodiments, the polyclonal antibody is recovered from B cells of the host.

In some embodiments, about $1 \times 10^5$ to about $1 \times 10^8$ viral particles are administered to a host in each administration. For example, about $1 \times 10^5$, about $5 \times 10^5$, about $1 \times 10^6$, about $5 \times 10^6$, about $1 \times 10^7$, about $5 \times 10^7$, or about $1 \times 10^8$ viral particles may be administered to a host per administration. In some embodiments, the administered dose is a split dose, wherein the total number of viral particles for administration is divided into 2, 3, 4, 5, 6, 7, 8, 9, or 10 sub-doses.

In some embodiments, about 10 to about 100 micrograms of viral protein are administered to a host in each administration. In some embodiments, about 1 to about 100 picograms of viral protein are administered to a host in each administration. In some embodiments, about 15 to about 50 picograms, or about 30 to about 40 picograms of viral protein are administered to a host in each administration. For example, about 5, about 10, about 15, about 20, about 25, about 30, about 35, about 40, about 45, about 50, about 55, about 60, about 65, about 70, about 75, about 80, about 85, about 90, about 95, or about 100 picograms of viral protein may be administered to a host in each administration. In some embodiments, about 10 picograms of viral protein are administered to a host in each administration. In some embodiments, about 11 picograms of viral protein are administered to a host in each administration. In some embodiments, about 12 picograms of viral protein are administered to a host in each administration. In some embodiments, about 13 picograms of viral protein are administered to a host in each administration. In some embodiments, about 14 picograms of viral protein are administered to a host in each administration. In some embodiments, about 15 picograms of viral protein are administered to a host in each administration. In some embodiments, about 16 picograms of viral protein are administered to a host in each administration. In some embodiments, about 17 picograms of viral protein are administered to a host in each administration. In some embodiments, the administered dose is a split dose, wherein the total amount of viral protein for administration is divided into 2, 3, 4, 5, 6, 7, 8, 9, or 10 sub-doses.

One or more sub-dose may be administered to the host peripherally, at different locations on the host's body. Each sub-dose may be administered at approximately the same time, or administration of the sub-doses may be staggered. For example, sub-doses may be administered at intervals of 15 minutes, 20 minutes, 30 minutes, 45 minutes, 1 hour, or 3 hours.

In some embodiments, the composition may be administered once, or more than once to the host. In some embodiments, the vaccine is administered once, twice, three times, four times, five times, six times, seven times, eight times, nine times, or ten times to the host.

The composition may be administered to the host every day, about every 3 days, about every 7 days, about every fourteen days, about once per month, or about once per year. In some embodiments, the composition is administered at least once per week, at least every two weeks, or at least once every six months. In some embodiments, the composition is administered once, twice, three times, four times, five times, six times, seven times, eight times, nine times, ten times, twelve times, fifteen times, twenty times, or twenty-five times in a year.

In some embodiments, a first dose (e.g., a prime dose) of the composition is administered, followed by a second dose (e.g., a boost dose) to the host. In some embodiments, the second dose is administered about 1 week, about 2 weeks, about 3 weeks, about 4 weeks, about 2 months, about 3 months, about 4 months, about 5 months, about 6 months, or about 1 year after the first dose. In some embodiments, the amount of viral protein in the first dose is greater than the amount of viral protein in the second dose. For example, the amount of viral protein may be about 10%, about 20%, about 30%, about 40%, about 50%, about 60%, about 70%, about 80%, about 90%, or about 100% greater than the amount of viral protein in the first dose. In some embodiments, the amount of viral protein in the first dose is less than the amount of viral protein in the second dose. For example, the amount of viral protein may be about 10%, about 20%, about 30%, about 40%, about 50%, about 60%, about 70%, about 80%, about 90%, or about 100% less than the amount of viral protein in the first dose. In some embodiments, the amount of viral protein in the first dose is about the same as the amount of viral protein in the second dose.

In some embodiments, a first inactivated composition and a second inactivated composition are administered to the host. In some embodiments, the second inactivated composition is administered after the first inactivated composition to boost the immune response. In some embodiments, immune response in the subject is monitored between administration of the first composition and the second composition. In some embodiments, the second composition is administered when it is determined that the host has not exhibited a satisfactory immune response following administration of the first composition.

In some embodiments, the composition is administered simultaneously or sequentially (either before or after) with an immune-enhancing agent. In some embodiments, the immune-enhancing agent is an angiotensin receptor blocker (ARB) or a beta blocker (BB). Exemplary immune-enhancing agents include losartan, telmisartan, irbesartan, azilsartan, candesartan, eprosartan, olmesartan, valsartan, propranolol, acebutolol, atenolol, betaxolol, bisoprolol, carteolol, carvedilol, esmolol, labetalol, metoprolol, nadolol, nebivolol, penbutolol, pindolol, propranolol, sotalol, and timolol. In some embodiments, the immune-enhancing agent is selected from the group consisting of losartan and propranolol. In some embodiments, the immune-enhancing agent is losartan. In some embodiments, the immune-enhancing agent is propranolol.

In some embodiments, a method for administering an immunogenic composition to a host comprises administering a composition comprising inactivated viral particles or other inactivated particles to the host. An adjuvant may optionally be administered at the time of vaccination. In some embodiments, an adjuvant is administered after vaccination to boost the immune response, for example about 6 hours, about 12 hours, about 24 hours, about 36 hours, about 48 hours, about 60 hours, or about 72 hours after administration. In some embodiments, the adjuvant comprises liposomes, e.g., CLDC. In some embodiments, an immune-enhancing agent such as losartan may be administered at or around the time of the administration. In some embodiments, a vaccine-enhancing agent such as losartan may be administered after administration, for example, about 6 hours, about 12 hours, about 24 hours, about 36 hours, about 48 hours, about 60 hours, or about 72 hours after administration. In some embodiments, an immune-enhancing agent such as losartan may be administered to the subject daily for an effective number of days, optionally beginning on the day that the inactivated particles are administered. In some embodiments, the immune-enhancing agent (e.g., losartan) is administered at a dose of between about 5 and about 100 mg/kg, for example about 5, about 10, about 15, about 20, about 25, about 30, about 35, about 40, about 45, about 50, about 55, about 60, about 65, about 70, about 75, about 80, about 85, about 90, about 95, or about 100 mg/kg.

Administration of an immunogenic composition (e.g., a composition comprising inactivated viral particles or other inactivated pathogenic particles) may elicit an immune response in the host. In some embodiments, the immune response may include one or more of the following: (i) upregulation of immunoglobulin expression (e.g., IgG, IgM, IgA, IgE), (ii) T-cell activation, (iii) modulation of innate immune cells (e.g., myeloid cells), and (iv) revival of "exhausted" T-Cell populations.

Also provided are polyclonal antibodies produced according to the methods described herein, and polyclonal antibodies produced using the immunogenic compositions described herein. The polyclonal antibodies may comprise, for example, IgG, IgM, IgA, IgY, or IgE, or mixtures thereof. In some embodiments, the polyclonal antibodies bind to a viral particle or other pathogen. In some embodiments, the polyclonal antibodies bind to the same viral particle or pathogen in the subject as was used to produce the polyclonal antibody in the host.

In some embodiments, a polyclonal antibody directed against SARS-Co-V-2 is provided. In some embodiments, the polyclonal antibody binds to the SARS-CoV-2 S1 protein, S2 protein, and/or receptor binding domain (RBD).

Methods for Treatment or Prevention of a Disease in a Subject in Need Thereof Using Polyclonal Antibodies The polyclonal antibodies produced the immunogenic compositions as described herein can be used to treat or prevent a disease in a subject in need thereof. In some embodiments, a polyclonal antibody generated in a host may be administered to a subject to treat or prevent a viral infection, such as a SARS-CoV-2 infection.

In some embodiments, a method for treating or preventing a disease or disorder in a subject in need thereof comprises administering to a subject in need thereof an effective amount of a polyclonal antibody as described herein. In some embodiments, a method for treating or preventing a COVID-19 in a subject in need thereof comprises administering to a subject in need thereof an effective amount of a polyclonal antibody as described herein. The effective amount may be determined according to standard practices. For example, the titer of circulating virus may be evaluated, and the dose of antibody required to achieve a specific neutralization of the virus may be established through Plaque Reduction Neutralization Tests in vitro. This information may subsequently be used to provide a suitable dose estimate for therapy.

In some embodiments, the subject is assessed for immune function and immune status prior to administration of the composition. Such assessments may include, but are not limited to, DTH skin testing, blood tests, lymph node aspirate tests, tumor tissue tests, and/or determination of whether the subject is anergic, B cell responsive, etc. In some embodiments, the subject is not assessed for immune function and immune status prior to administration of the composition. In some embodiments, the subject is immunocompetent. In some embodiments, the subject is immunocompromised.

All patents, patent applications, references, and journal articles cited in this disclosure are expressly incorporated herein by reference in their entireties for all purposes.

EXAMPLES

The following examples, which are included herein for illustration purposes only, are not intended to be limiting.

Described below are various studies evaluating a photochemical process for inactivation of viral particles, including SARS-CoV-2, and use of an inactivated SARS-CoV-2 whole virion for prevention of COVID-19 infection. These studies demonstrate the ability of this process to inactivate SARS-CoV-2 virus via a specific, targeted guanine base modification. This work also demonstrated the ability of products made via this method to induce a potent immune response to vaccination. This response triggered both Th1 and Th2 type immune pathways, leading to generation of neutralizing antibodies and cellular responses capable of protecting vaccinated animals against intranasal challenge with $10^1$ pfu SARS-CoV-2.

Moreover, the use of adjuvants was found to boost the levels of neutralizing antibody titers. Interestingly, the non-adjuvanted formulation still provided sufficient protection to prevent viral production and shedding in challenged animals. Adjuvanted formulations, particularly CpG 1018 demonstrated the lowest levels of viral shedding, preservation of normal lung morphology and airway passage integrity and reduced numbers of infiltrates in the trachea and lung tissue. The adjuvants used in this study are known to promote Th1 immune pathway responses.

The data also shows a vaccine candidate for COVID-19 produced by this method (SolaVax) is effective in providing protection against challenge infection in a sensitive hamster model. The use of this inactivation/viral production methodology may afford a means to rapidly produce vaccine candidates in response to both emergent and existing disease threats. Given the nature of the photosensitizer (riboflavin) and equipment utilized in this setting, such an approach may afford a facile method to prepare vaccine candidates in a logistically practical and cost-effective manner that avoids issues associated with current methods for production of inactivated vaccines. This more selective method of nucleic acid modification, without extensive protein alteration which is known to occur with current inactivation approaches, may also result in more effective vaccination at lower immunogen dose, thus facilitating vaccine distribution and availability in diverse regions of the global community.

Example 1: Treatment with Riboflavin and UV Light Inactivates Recombinant Viral Particles Riboflavin and UV light are used to carry out specific DNA and RNA chemistry with viral particles that are subsequently be used in vaccine preparations. The virus is inactivated in situ in its native form. The photochemistry of Riboflavin and UV light has been shown to be specific to nucleic acids and not induce damage or modification to proteins (See, e.g., Kumar et al.) By preventing replication of the target agent while minimizing or reducing the amount of peripheral damage caused to the target agent, a viral particle is generated that contains all the potential antigenic targets for immune response without the capacity for replication post-infection.

The utility of this technique has been demonstrated using recombinant viruses. The study compared the outcomes between samples treated with psoralens and those treated with riboflavin and UV light. Several key concepts were demonstrated in this work. First, Riboflavin and UV chemistry worked as well or even better than Psoralen and UV chemistry at inactivating viruses. See FIG. 2A-2D. Second, it did so without significant modification of proteins in the lipid capsid. See FIG. 3A-3D. Third, the residual riboflavin left after treatment did not induce toxicity in animal models that were administered the treated preparations. This stands in contrast to results observed in animals dosed with psoralen and UV treated materials. See FIG. 4A-4B. Additionally, this approach was able to induce an immunological response in animal models without inducing expression of virus-mediated transcription of transgene product. See FIG. 5 and FIG. 6A-6D.

Example 2: Generation of an Inactivated MERS Co-V Vaccine Candidate

A photochemical method is used to provide an inactivated vaccine candidate for use in humans to address MERS Co-V. This vaccine candidate is prepared for administration as an injectable (IM, ID or SC) using standard volumes for injection as specified in programmatic suitability for PQ or needle-free delivery. The vaccine provides long-term protection for administration to those at high ongoing risk of MERS-CoV such as healthcare workers and those working with potentially infected animals. The vaccine could be administered to those in these populations as a preventative measure to provide protection as well as during times of outbreak.

The ability of this technique to inactivate MERS CoV in blood plasma was demonstrated (Keil et al., "Inactivation of Middle East respiratory syndrome coronavirus (MERS-CoV) in plasma products using a riboflavin-based and ultraviolet light-based photochemical treatment," Transfusion, Vol. 56, 2016). In these studies, treatment conditions required six minutes of light exposure with a concentration of 50 micromolar riboflavin solution and 300 mLs of product volume standardly used in the blood bank setting. Results are provided in FIGS. 7A and 7B.

Storage parameters for this vaccine formulation allow for adequate stockpiling. The production method itself, given the rapid nature of turnaround from isolation to production of the vaccine allows for use in emergent situations and timely response to outbreaks.

Example 3: Assessment of Immune Responses

Two techniques are used to assess immune responses (in mice, rabbits) and protective efficacy (in mice) elicited by the candidate MERS coronavirus vaccine, both described by Adney and colleagues (2014, 2016): 1) neutralizing antibody titers in sera are assayed by plaque reduction neutralization test with an 80% cutoff; 2) virus titration of tissue samples from vaccinated and MERS CoV challenged animals by plaque assay on Vero cells.

The animal model used to evaluate protective efficacy of the candidate vaccine is the transgenic mouse model developed by Agrawal et al. (2015). These mice were engineered to express the human dipeptidyl peptidase 4 (DPP4) MERS CoV receptor in all tissues. Intranasal infection of these mice with MERS CoV leads to lethal disease in 5-6 days, with high titers of virus in lung and brain.

To elucidate the mechanisms of protective immunity for the candidate vaccine, humoral immune responses are characterized over time, both after vaccination and challenge, and determine the lung and brain burdens of virus 3 days after challenge.

Cell-mediated immunity may also be assessed through ELIspot assays.

Example 4: Inactivation of SARS-CoV-2 Using Riboflavin and UV Light

Figure 8:
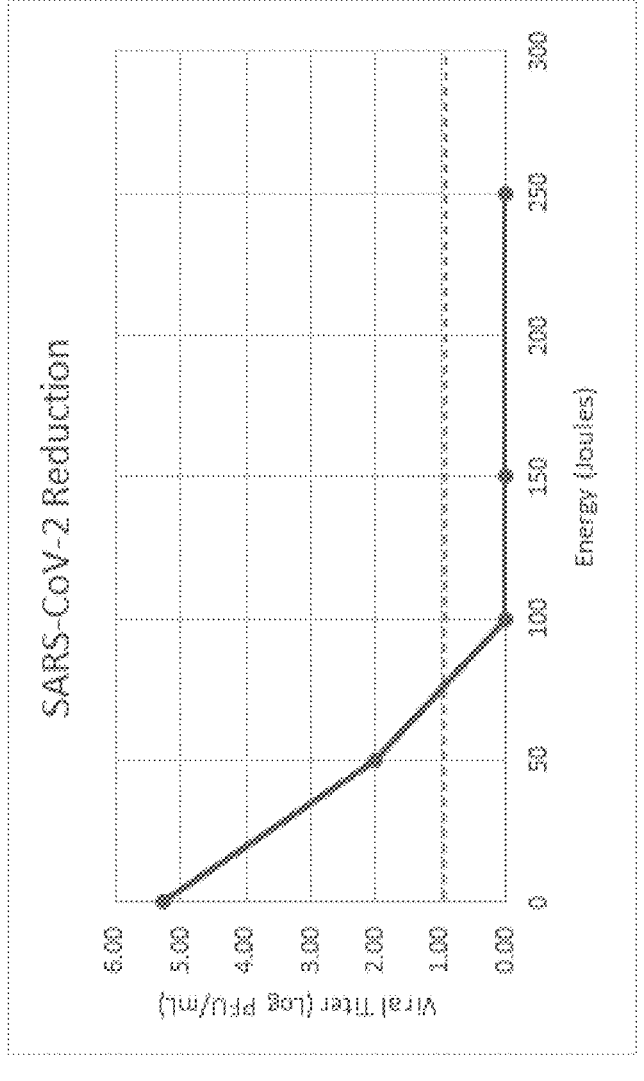
FIG. 8 is a graph showing reduction of SARS-CoV-2 titer after treatment with riboflavin and UV light. After treatment with about 100 Joules of light, the sample was completely inactivated (i.e., no infectious SARS-CoV-2 particles could be detected.)

To determine whether treatment with riboflavin and UV light can inactivate SARS-CoV-2, SARS-CoV-2 was propagated and purified in vitro. The inactivation run was performed in the Mirasol® device (Terumo BCT, Lakewood, CO) using 100 mLs of solution comprising 50 μM riboflavin and spiked with $4 \times 10^6$ virus per mL (6.6 Log virus/mL). This yielded a final tier of virus of about 5.2 Log virus per mL. The container utilized for treatment was a standard Mirasol® PRT illumination bag (citrate plasticized PVC, 1 Liter volume, Terumo BCT, Lakewood, CO). The limit of detection was 1.0 Log per mL, which means greater than 4.2 Log Reduction in viral titer. Energy dose utilized was measured on the device with a calibrated optical meter. A dose of 100 Joules was delivered in 19 seconds. Complete inactivation was achieved at this time point, to the limit of detection (FIG. 8).

The inactivated viral particles were then characterized, to determine whether the riboflavin/UV light treatment had modified the viral RNA. This analysis was performed using shotgun RNA sequencing. Briefly, RNA was extracted from viral samples pre- and post-treatment with riboflavin/UV light using a standard Trizol extraction protocol coupled with column-based purification and on-column DNase treatment. Damaged RNA bases can be recognized during reverse transcription, leading to characteristic mutations in cDNA sequences. Low quality bases were removed from reads and adapter sequences, then reads were aligned to an existing reference SARS-CoV-2 genome.

This mapping was used to generate a new consensus sequence for SARS-CoV-2 ("CSU SARS-CoV-2") (SEQ ID NO: 20). The isolate contained 5 consensus-changing mutations relative to GenBank accession MN985325.1 (SEQ ID NO: 23), from which it was derived (Table 2). These included a G to A substitution at position 23616 of the genome that results in an arginine to histidine substitution at position 685 within the polybasic cleavage site of the spike protein.

TABLE 2

Consensus changing mutations in the
SARS-COV-2 genome of SEQ ID NO: 20
relative to SEQ ID NO: 23

| Position in Genome (relative to SEQ ID NO: 23) | Gene | Nucleotide Substitution | Amino Acid Substitution | Variant Frequency (Fraction of reads with alternate base) |
|---|---|---|---|---|
| 13845 | Nsp12 | U → G | D135E | 0.86 |
| 22205 | S | G → C | D215H | 0.90 |
| 23616 | S | G → A | R685H | 0.87 |
| 26542 | M | C → U | T7I | 0.93 |
| 28853 | N | U → A | S194T | 0.94 |

Figure 14:
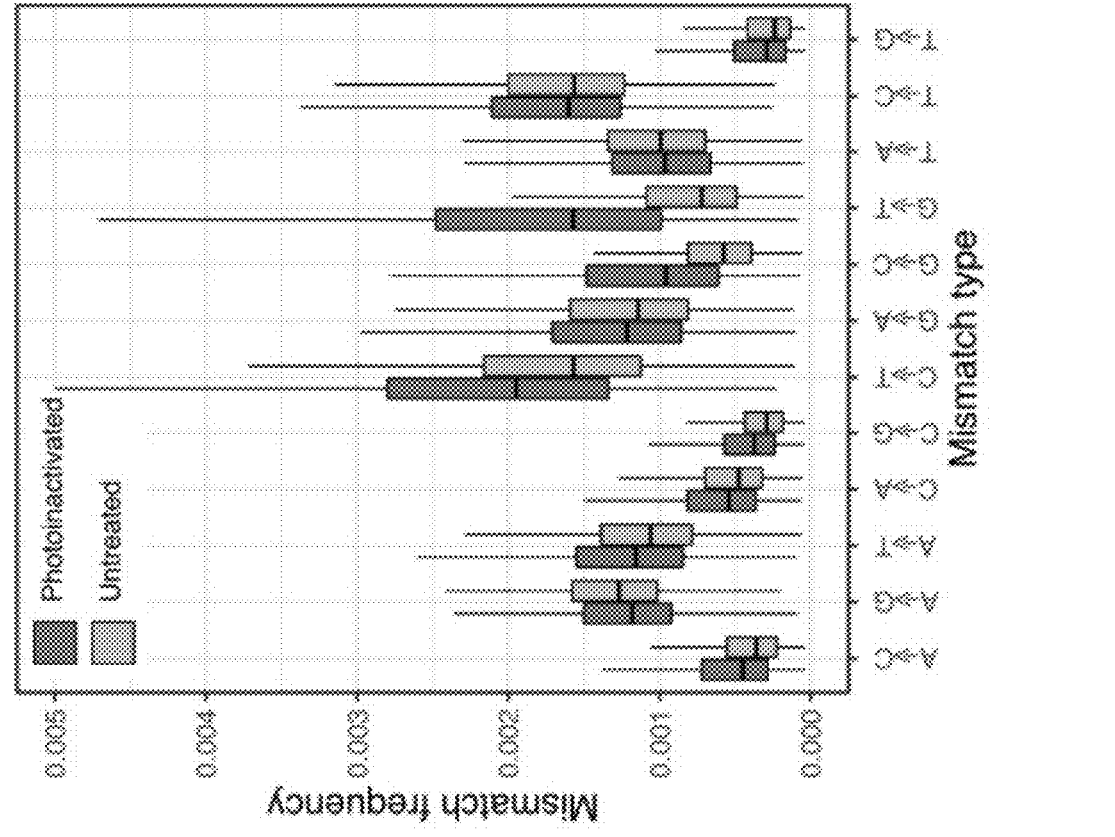
FIG. 14 shows that G to T and G to C mutations are elevated in SARS-CoV-2 RNA treated with riboflavin and UV light. The frequencies of the indicated types of mutations in SARS-CoV-2 derived reads were tabulated in pre- and post-riboflavin/UV treatment datasets. The ratio of the frequencies in the post-treatment to the pre-treatment samples are plotted for the indicated mutation types. Mismatches are relative to the SARS-CoV-2 positive sense RNA sequence.
Figure 15:
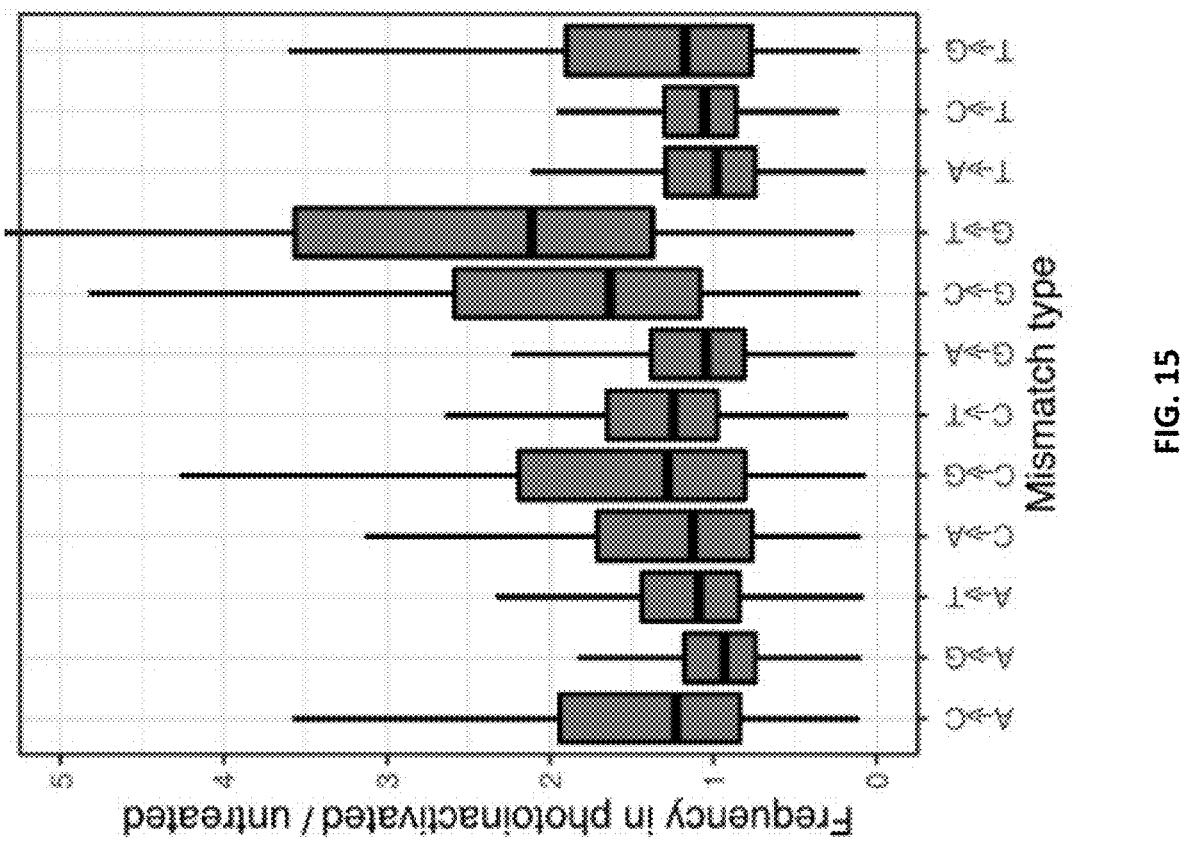
FIG. 15 shows the ratio of mismatch frequencies in inactivated and untreated datasets, normalized to the frequency of bases in the reference sequence. Boxplots represent distributions of values across all sites in the genome.
Figure 23:
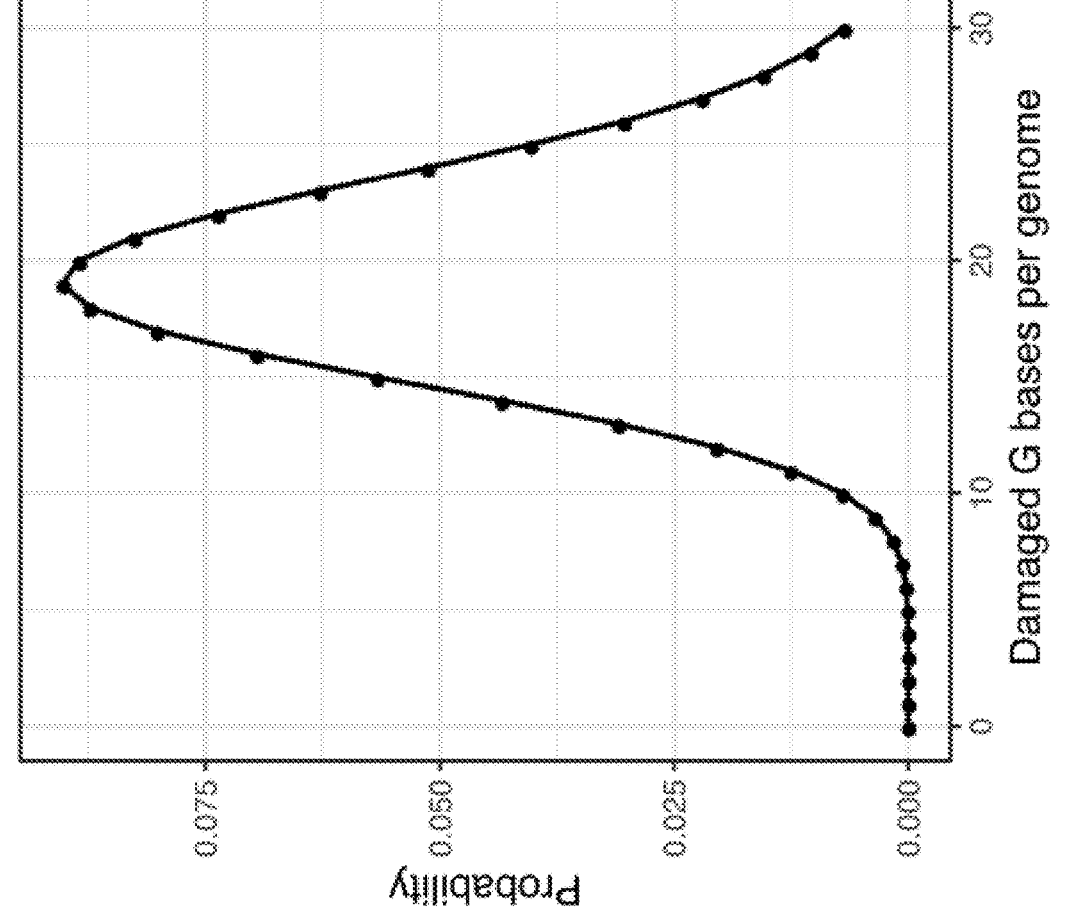
FIG. 23 shows a Poisson distribution estimating the probability of a SARS-CoV-2 genome containing the indicated number of damaged G bases, assuming 5863 Gs per genome and a combined mismatch frequency of 0.0033 for G to C and G to U mutations.
Figures 24A, 24B, 24C, 24D, 24E, 24F:
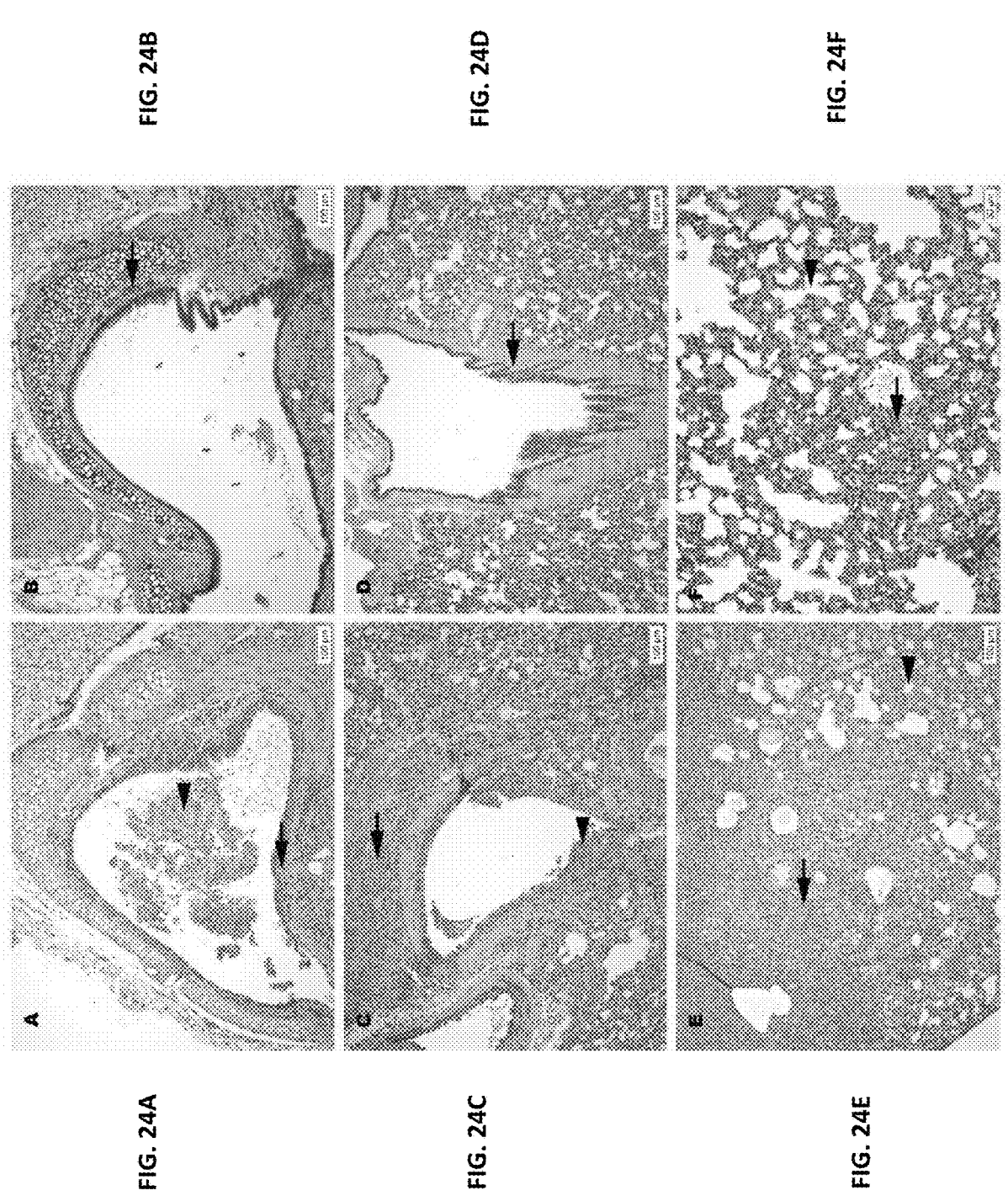
FIG. 24A-24F provides representative histology of differences between unimmunized SARS-CoV-2 infected controls (FIGS. 24A, 24C and 24E) and infected hamsters vaccinated with SolaVAX and CpG 1018 adjuvant (FIGS. 24B, 24D and 24F).

Reads to this new consensus sequence were then remapped and mismatched bases were tabulated with high quality scores. The frequencies of the different types of mutations are plotted in FIG. 14 and FIG. 15. Evidence consistent with oxidative damage to G bases in viral RNA was detected in the form of elevated frequencies of G to U and G to C mismatches (FIG. 14). These lesions would result from the misincorporation of an A or a G opposite an oxidized G during reverse transcription. The frequency of G to U mutations was 2.3× higher in photoinactivated RNA than in untreated RNA (0.0021 vs. 0.0009), and this ratio was 1.8× for G to C mutations (0.0012 vs 0.0007; FIG. 15). Given the combined mutation frequency of ~0.0033 and 5,863 G bases in the SARS-CoV-2 USA-WA1 genome, it is calculated that an average of 19.6 G bases will be damaged per genome. Using these parameters to estimate the number of damaged G bases per genome with a Poisson distribution estimated that 1 genome per $3.0 \times 10^9$ genomes will have no damaged bases (FIG. 23).

Figure 22:
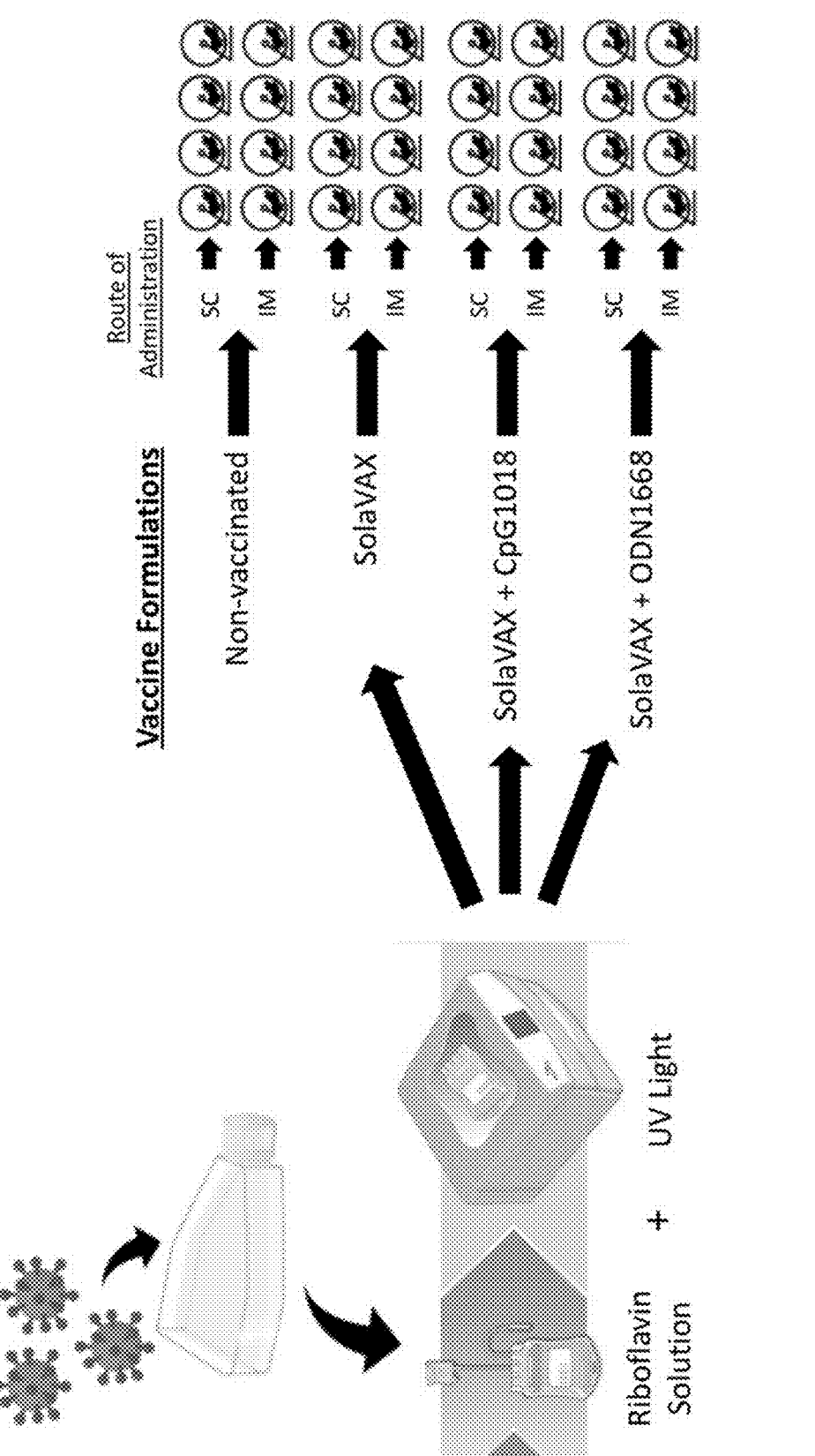
FIG. 22 is a schematic showing a protocol for vaccinating various groups of hamsters. Within each group, hamsters were divided into two subgroups that were vaccinated by either subcutaneous (SC) or by intramuscular (IM) injection. More specifically, SARS-CoV-2 virus (isolate USA-WA1/2020) was propagated in Vero E6 cells (ATCC CRL-1568). The virus was then inactivated using the Mirasol® PRT System by adding a riboflavin solution to the virus stock and exposing the solution to UV light, and the inactivated virus was concentrated and prepared with or without adjuvant (CpG 1018, ODN1668). Hamsters were immunized with various SolaVAX vaccine formulations (i.e., vaccine compositions comprising SARS-CoV-2 inactivated using riboflavin/UV light) either subcutaneously (SC) or intramuscularly (IM) in groups of four animals.

Example 4: Inactivated SARS-CoV2 Viral Vaccine Rapidly Reduces Viral Load In Vivo The inactivated SARS-CoV2 preparations of Example 3 were used to create a vaccine composition and tested in vivo (referred to herein as the first in vivo study, or the first challenge study). Hamsters were immunized according to the protocol shown in FIG. 16. Briefly, hamsters were immunized on day 0 with a vaccine comprising inactivated SARS-CoV-2 sample formulated with either (i) no adjuvant, (ii) a CpG 1018 adjuvant, or (iii) an ODN 1668 adjuvant. The vaccine was administered either subcutaneously (SC) or intramuscularly (IM), according to the scheme shown in Table 3 and FIG. 22. Specifically, the inactivated viral sample was mixed 1:1 with an equal quantity of saline, a 1:1 mixture of CpG 1018 solution in water, or a 1:1 mixture of ODN 1688 in water. The CpG 1018 solution comprised 0.6 mg/ml CpG 1018 in a 20 mM Tris, 100 mM NaCl buffer at pH 7.5. Each vaccine comprised approximately 35 picograms of SARS-CoV-2 viral protein. 4 animals were tested in each group (1A, 1B, 2A, 2B, 3A, 3B, 4A, 4B).

TABLE 3

Vaccination scheme

| Group | Route | Vaccination | Adjuvant |
|---|---|---|---|
| 1A | SC | Vehicle (saline) | — |
| 1B | IM | Vehicle (saline) | — |
| 2A | SC | Inactivated SARS-COV-2 | — |

TABLE 3-continued

Vaccination scheme

| Group | Route | Vaccination | Adjuvant |
|---|---|---|---|
| 2B | IM | Inactivated SARS-COV-2 | — |
| 3A | SC | Inactivated SARS-COV-2 | CPG 1018 |
| 3B | IM | Inactivated SARS-COV-2 | CPG 1018 |
| 4A | SC | Inactivated SARS-COV-2 | ODN 1668 |
| 4B | IM | Inactivated SARS-COV-2 | ODN 1668 |

At day 21, a booster dose of vaccine was administered, and at day 42, the animals were inoculated intranasally with SARS-CoV-2. More specifically, hamsters were challenged with $10^5$ plaque forming units (pfu) of live SARS-CoV-2 intranasally. No clinical signs, including elevated body temperature, were observed in the hamsters, thus making them an ideal model for subclinical infection with SARS-CoV-2. From the time of viral challenge to necropsy a body weight loss of 4-7.2% was observed in all groups including the Controls.

Figures 9A, 9B:
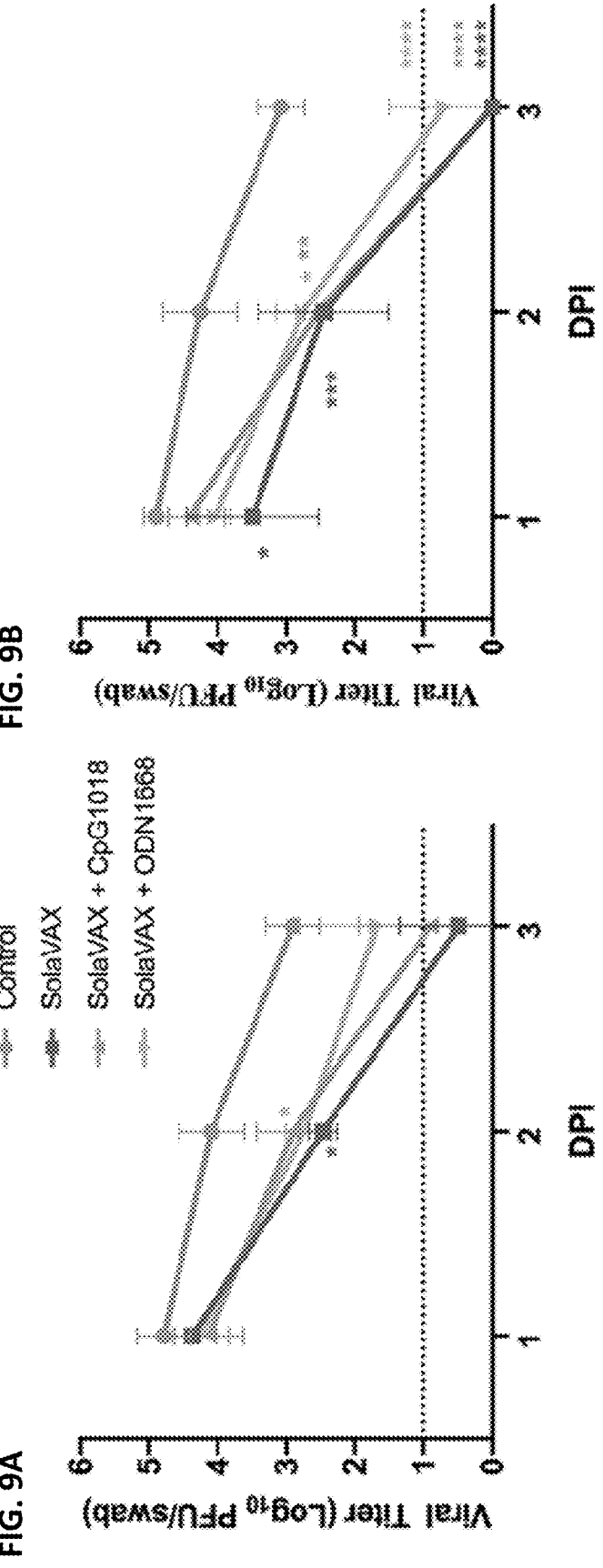
FIG. 9A-9G provides graphs which show viral loads from oropharyngeal swab and respiratory tract tissues after challenge with live SARS-CoV-2 virus. Oropharyngeal swabs were taken from all hamsters on 1, 2, and 3 days post infection (DPI). Viral titers of swabs collected from hamsters vaccinated via subcutaneous (SC) (FIG. 9A) and via intramuscular (IM) (FIG. 9B) routes were determined by plaque assay. The presence of infectious virus was also determined in turbinates (FIG. 9C), trachea (FIG. 9D), right cranial lung lobe (FIG. 9E), and right caudal lung (FIG. 9F) of each hamster three days after live virus challenge. Representative histology images from lung are provided in FIG. 9G. Data points represent group mean+/−standard deviation (SD). Asterisks above bars indicate statistically significant difference in viral titers between Control and vaccine group (**=p<0.0001, *=p<0.001, **=p<0.01, *=p<0.05). Limit of detection denoted as horizontal dotted line.

Oral-pharyngeal swabs were taken 1-3 days post-infection (dpi) to monitor viral replication. At 1 dpi infectious virus was detected in all groups (FIG. 9A-9B). At 2 dpi viral replication begins to decline especially in the vaccinated groups. And by 3 dpi, viral replication was detected only in the Control group (1A, SC and 1B, IM) and the ODN cohort (4A, SC only). This shows that vaccination in hamsters reduced the amount of viral replication in the oropharynx after SARS-CoV-2 infection.

In addition to oral-pharyngeal swabs, necropsies were performed, and tissues collected at 3 dpi to determine vaccine efficacy after live virus challenge. These tissues were specific to respiratory tract and included the right cranial lung lobe, right caudal lung lobe, trachea, and nasal turbinates. Beginning with nasal turbinates (FIG. 9C), these tissue samples revealed high viral titers for all hamsters regardless of vaccination status. This was expected due to the route of live virus inoculation, yet the Control group had higher viral titers compared to the vaccinated groups. Moreover, there was a significant decrease in viral titers in the CpG group within the IM subgroup demonstrating that the IM injection of SolaVAX+CpG 1018 offered the best protection against viral replication in nasal turbinates.

Figure 9D:
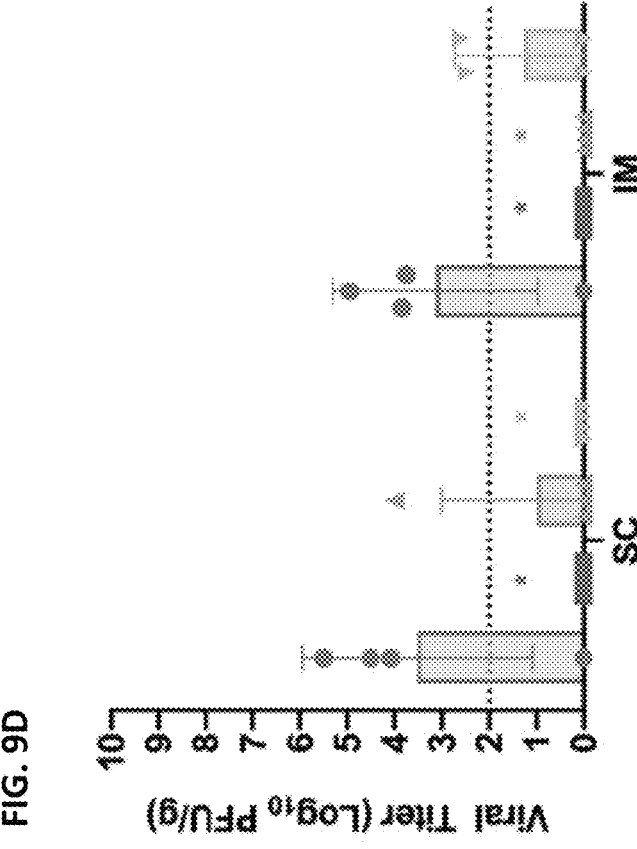
Figure 9C:
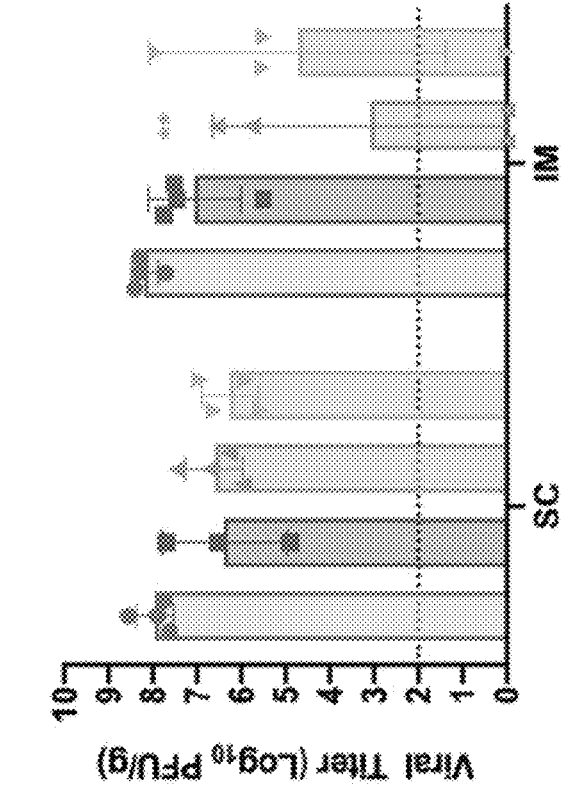

Trachea was also evaluated to see if vaccination would protect the lower airway against SARS-CoV-2 infections (FIG. 9D). The viral titers are less than what was observed in the turbinates and support what has been seen in previous experimental hamster infections with SARS-CoV-2. Groups treated with Solavax and ODN showed a significant reduction in viral replication by SC administration while groups treated with Solavax and CpG showed a significant reduction by IM administration when compared to their respective Controls. In summary, SolaVAX+CpG 1018 administered IM is effective in protecting against viral replication in both the nasal turbinates and trachea of hamsters.

Figure 9F:
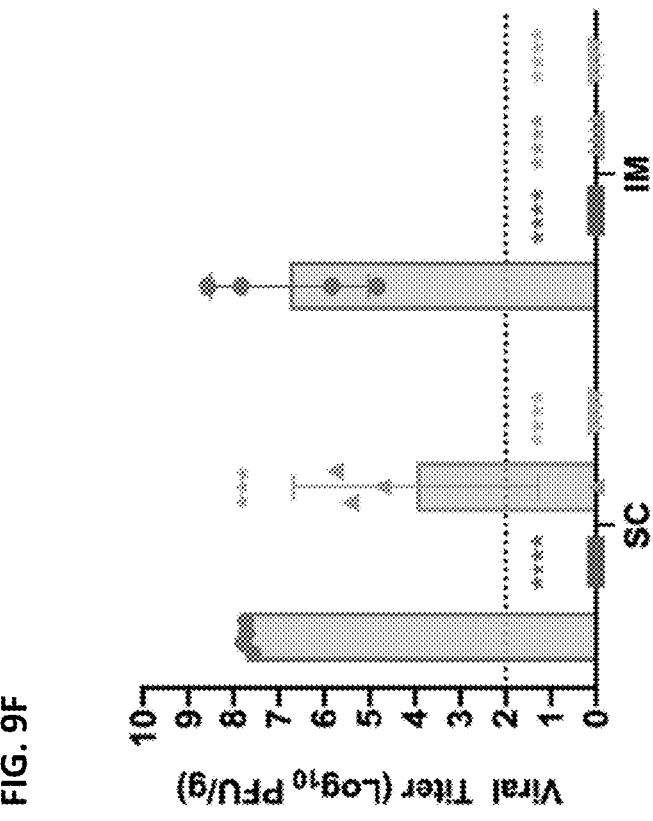
Figure 9E:
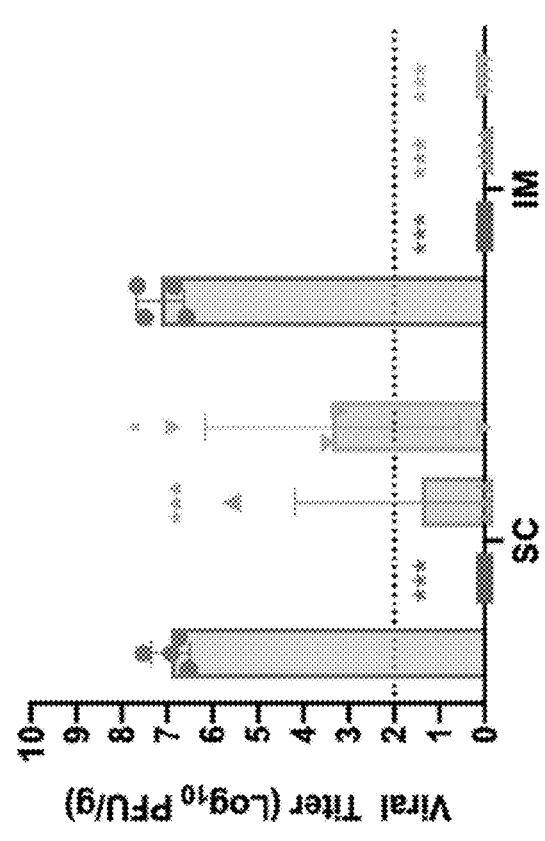
Figure 9G:
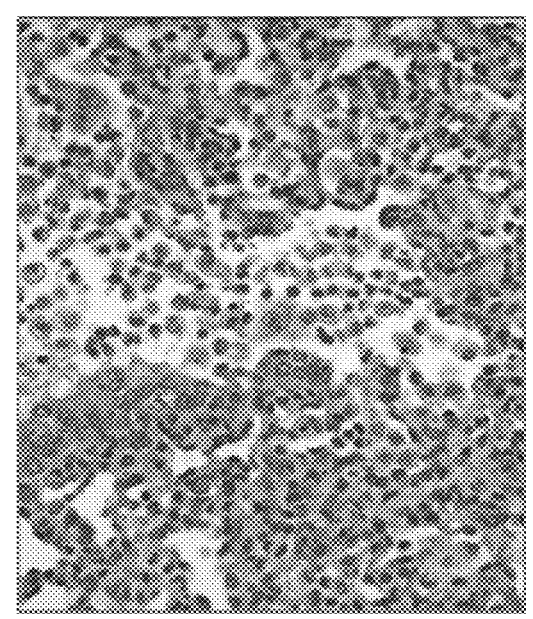

Cranial and caudal lung lobes were collected to evaluate protection against SARS-CoV-2 in multiple lung lobes. Previous experimental infections with SARS-CoV-2 in hamsters revealed the viral load between the two lobes are usually similar, as was observed in the Control groups (FIG. 9E-9F). However, the cranial lobe is commonly affected first before the caudal lobe. Therefore, it is of interest to evaluate the cranial lung lobe for vaccine efficacy against SARS-CoV-2 early in disease progression. Within the SC subgroup, all hamsters except for one hamster in the CpG cohort and three hamsters in the ODN cohort had no detectable virus (FIG. 9E). Within the IM subgroup, no infectious virus was detected in any of the vaccinated hamsters. Therefore, vaccination appeared to have reduced viral replication in the cranial lung lobes compared to non-vaccinated hamsters.

Figures 25A, 25B:
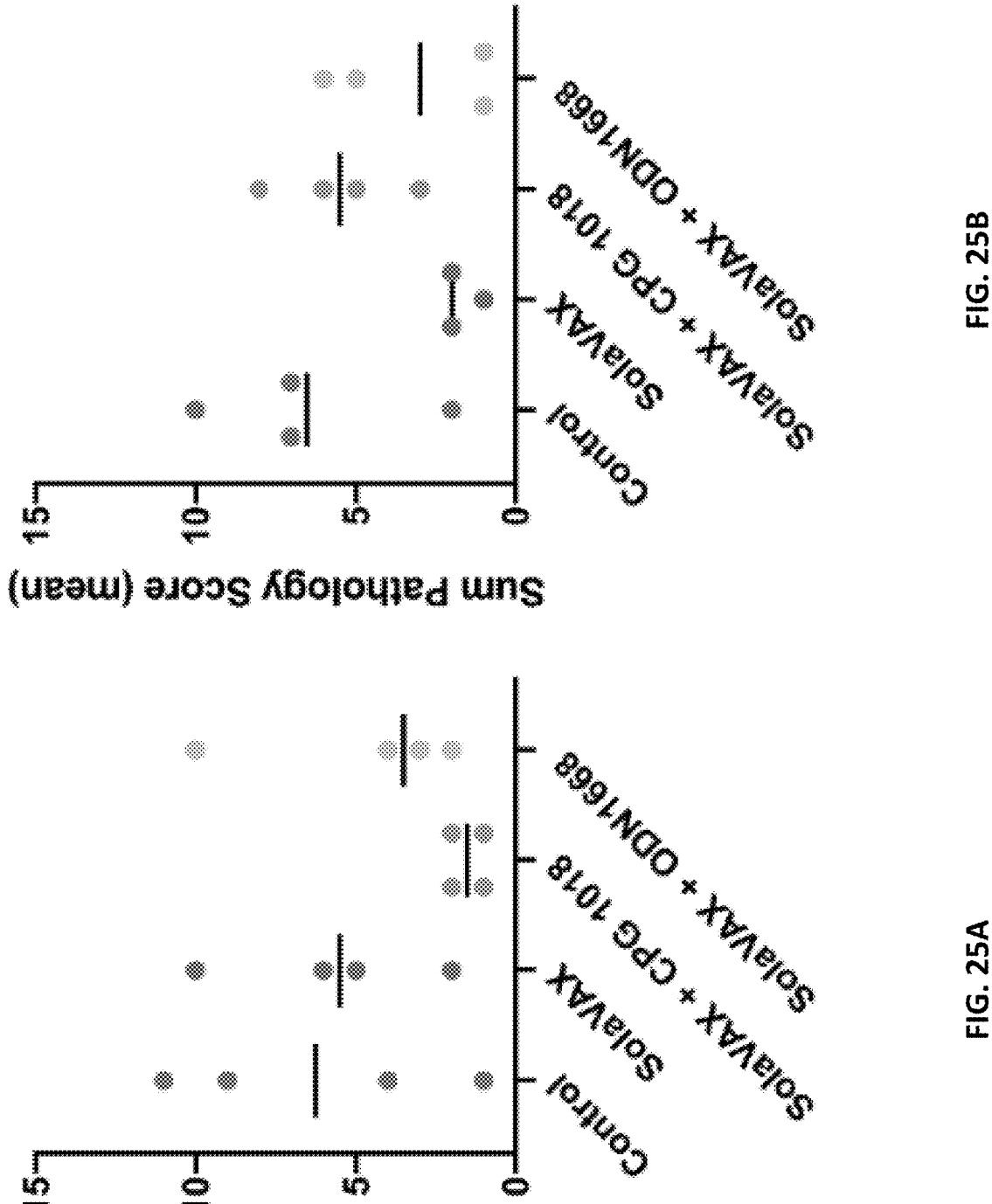
FIG. 25A-25B shows semiquantitative lung pathology scores from all study groups separated by route of administration. Overall severity of lung pathology was determined by the sum of severity scores for four pathological features with 12 being the maximum assigned sum of severity scores. Data are shown for all groups, separated by intramuscular (FIG. 25A) and subcutaneous (FIG. 25B) routes of immunization. Data points represent sum scores of individual animals with the bar representing the mean.

Lastly, the caudal lung was evaluated for the presence of infectious virus. As with the cranial lung, viral replication was detected in all hamsters in the Control group (FIG. 9F). Within the SC subgroup, only three hamsters within the CpG cohort In the IM subgroups, no viral replication was detected in any of the vaccinated groups. As seen with the cranial lung, all the vaccinated groups appeared to have reduced viral replication in the caudal lung lobes compared to non-vaccinated hamsters.

protected, but to a lesser extent than the CpG group. Notably, however, the SolaVax group offered a level of protection from severe pulmonary pathology compared to the Controls, and while not achieving statistical significance, this was observed primarily in hamsters vaccinated by SC route (FIG. 25A, 25B). Lung tissues isolated from the hamsters were also evaluated using histology. In three hamsters sacrificed at 3 DPI, acute, moderately severe broncho-interstitial pneumonia was observed, and in three hamsters sacrificed at 7 DPI, subacute, severe broncho-interstitial pneumonia was observed. Observations are summarized in Table 4.

TABLE 4

| Histopathology Observations | | |
|---|---|---|
| Vaccine group | Trachea | Lung |
| 1B (Vehicle) | Neutrophils and lymphocytes dominated submucosal and intraepithelial infiltrate with high number of neutrophils in lumen extending down to mainstem bronchi. Neutrophils fill main bronchi in other lung lobes. | Regionally extensive area of consolidating lymphocytic interstitial pneumonia with neutrophils. Areas of larger bronchi have destroyed epithelial surface with ulceration and heavy neutrophils and lymphocyte infiltration. Multiple areas of alveolar interstitial pneumonia. |
| 2B (no adjuvant, IM administration) | Mild submucosal lymphocytic inflammation with rare infiltration of epithelium. Epithelial surface is intact. | Rare small foci of interstitial pneumonia are present. Large and small airways are unaffected. |
| 3B (CpG1018 adjuvant, IM administration) | Minimal to no inflammation. | Large and small airways unaffected. |

Hematoxylin and eosin (H&E) stained slides, including sections of lung, trachea, heart and spleen, were reviewed for histopathological changes due to SARS-CoV-2 infection and alleviation of pathology through vaccination (FIG. 9G, 24A-24F). No significant pathology was identified in heart or spleen tissue. Control hamsters infected with SARS-CoV-2 demonstrated the most severe pulmonary pathology. Histopathological features of SARS-CoV-2 infection in this group included a strong predilection for larger airways including hilar bronchi and trachea. Bronchi and trachea contained lymphocytic inflammation infiltrating the mucosal epithelium and submucosa in seven of eight Control hamsters, accompanied by neutrophil dominated inflammation disrupting the epithelial surface or completely filling the airway lumen present in five of eight Control hamsters. Control hamsters also developed the most severe alveolar pathology. Alveolar walls were expanded by mononuclear inflammatory cell infiltrates, which limited alveolar air space, and in regionally extensive areas of the lung, led to consolidating interstitial pneumonia with complete effacement of normal alveolar structures. Inflammatory processes in the alveolar spaces were uniformly cell-mediated and lacked evidence of vasoactive inflammation including an absence of edema fluid and fibrin.

Among vaccinated hamsters, those in the CpG (IM) group were the best protected from viral-induced pathology. Hamsters immunized with this formulation had improved air space capacity, a lack of consolidating inflammation, and bronchi or trachea with mild inflammatory changes or essentially normal morphology. ODN hamsters were also FIG. 17A shows representative images from a morphometric analysis of lung alveolar airspace. As shown in the bottom panel of FIG. 17A, the lungs of an unvaccinated hamster comprise about 11% alveolar airspace (cross-sectional surface area) after viral challenge, indicating that the virus causes inflammation and/or blockage of these airways. Notably, as shown in the top panel, the lungs of a hamster in vaccination group 3B (vaccinated with inactivated SARS-CoV-2 plus CpG 1018 adjuvant), comprising about 33% alveolar airspace, were protected from such inflammation/blockage. The histology images were also used to calculate a morphology score, as shown in FIG. 17B. Morphology scores were improved in all vaccination groups, as compared to the control.

Example 5: Inactivated SARS-CoV-2 Vaccine Produces a High Neutralizing Antibody Titer In Vivo Hamsters were immunized on day 0 (Dose 1) according to the vaccination scheme of Table 3 (n=4 hamsters per group) and the protocol of FIG. 16 (first challenge study). Each hamster in the vaccinated group received 100 μL of vaccine (about 15 ng viral protein). At day 21, the animals were given a second "booster" dose of vaccine (Dose 2, about 13 ng viral protein). In Dose 1, the amount of inactivated virus administered was about $2.2 \times 10^6$ pfu-equivalents, and in Dose 2 the amount of inactivated virus administered was $1.8 \times 10^6$ pfu-equivalents. Blood samples were collected at days 21 and 42. Neutralizing antibody titers were measured in the serum samples in those groups that received the vaccine by intramuscular injection (Groups 1B, 2B, 3B, 4B) according to a standard assay. In this assay, a serum sample from each animal was diluted and mixed with a suspension of SARS-CoV-2.

The samples were then incubated, to allow time for antibodies to react with the virus. Subsequently, plaque assays were used to quantify infectious virus. Briefly, all samples were serially diluted 10-fold in BA-1 media supplemented with antibiotics. Confluent Vero E6 cell monolayers were grown in 6-well tissue culture plates. The growth media was removed from the cell monolayers and washed with PBS immediately prior to inoculation. Each well was inoculated with 0.1 mL of the appropriate diluted sample. The plates were rocked every 10-15 minutes for 45 minutes and then overlaid with 0.5% agarose in media with 7.5% bicarbonate and incubated for 1 day at 37° C., 5% $CO_2$. A second overlay with neutral red dye was added at 24 hours and plaques were counted at 48-72 hours post-plating. Viral titers are reported as the $\log_{10}$ pfu per swab or gram (g). Samples were considered negative for infectious virus if viral titers reached the limit of detection (LOD). The theoretical limit of detection (LOD) was calculated using the following equation: LOD=log [1/(N×V)], where N is the number of replicates per sample at the lowest dilution tested; V is the volume used for viral enumeration (volume inoculated/well in mL). For oropharyngeal swabs the was 10 pfu/swab or 1.0 log 10 pfu/swab. For tissues the LOD was 100 pfu/g or 2.0 log 10 pfu/g.

Figures 10A, 10B:
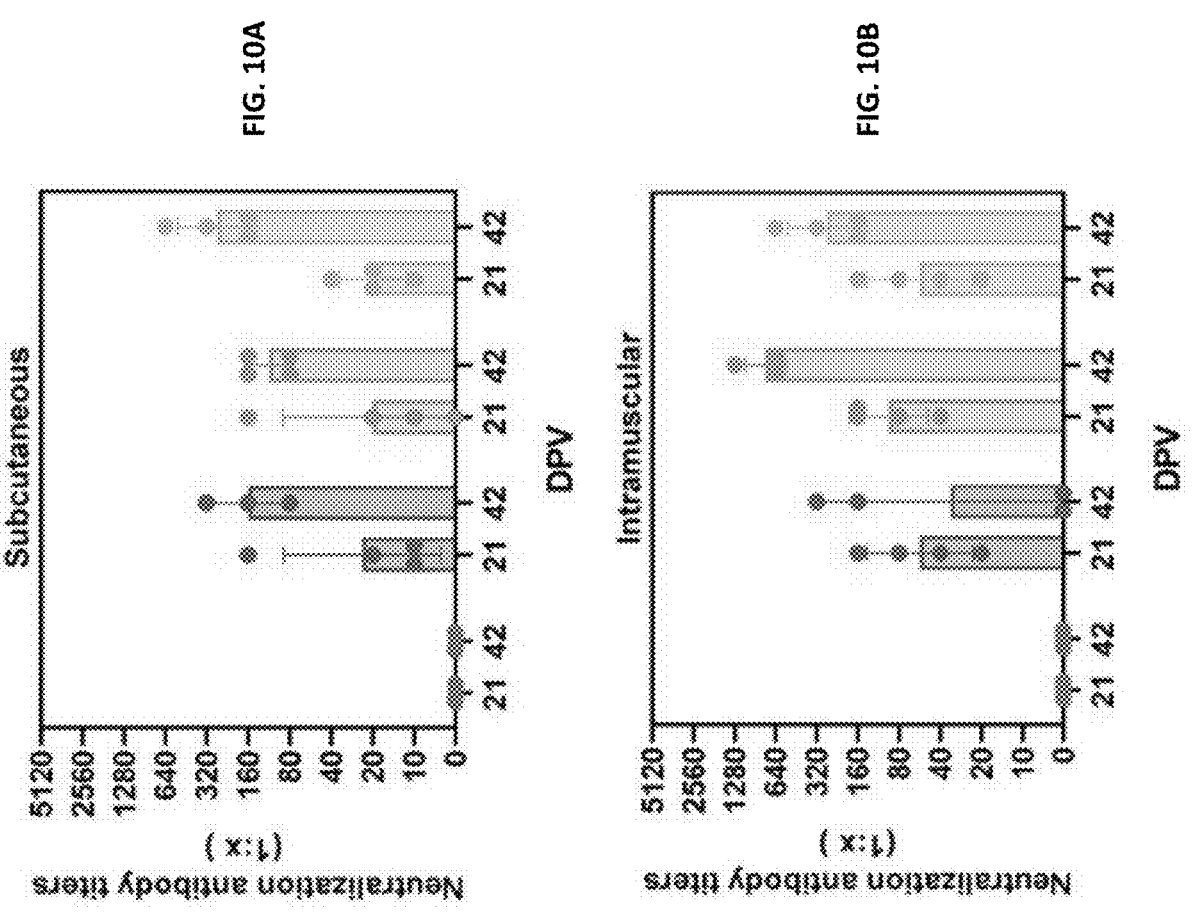
FIG. 10A-10B show the detection of neutralizing antibodies in hamsters by PRNT90 after vaccination (FIG. 10A and FIG. 10B). A plaque reduction neutralization test with a cutoff of 90% was used to determine neutralizing antibody production after 21 and 42 days post vaccination (DPV) for both SC (FIG. 10A) and IM (FIG. 10B) routes of vaccine administration. The prime vaccination was given at 0 DPV and a booster vaccination given at 21 DPV. Data points represent group mean+/−SD.

The production of neutralizing antibodies was determined by plaque reduction neutralization test (PRNT). Briefly, serum was first heat-inactivated for 30 minutes at 56° C. in a water bath. Then serum samples were diluted two-fold in BA-1 media starting at a 1:5 dilution on a 96-well plate. An equal volume of SARS-CoV-2 virus (isolate USA-WA1/2020) was added to the serum dilutions and the sample-virus mixture was gently mixed. The plates were incubated for 1-hour at 37° C. Following incubation, serum-virus mixtures were plated onto Vero E6 plates as described for virus plaque assays. Antibody titers were recorded as the reciprocal of the highest dilution in which >90% of virus was neutralized (PRNT90). All hamsters were tested for the presence of antibodies against SARS-CoV-2 prior to vaccination. A plaque reduction neutralization test (PRNT) with a 90% cutoff was performed to measure neutralizing antibodies against SARS-CoV-2 after vaccination. A PRNT 90 titer represents the serum sample dilution factor that yields an 90% reduction in plaque forming units. For example, a PRNT 90 titer of 100 means that a serum sample can be diluted to 1/100 of its initial concentration and still reduce plaque formation by about 90% compared to controls. Neutralizing antibodies were measured 21 days after the initial vaccination and then at 42 days after initial vaccination (21 days after booster vaccination). All hamsters were seronegative against SARS-CoV-2 prior to vaccination. As expected, hamsters in the Control group did not develop a detectable neutralizing antibody response against SARS-CoV-2 (FIGS. 10A and 10B). In contrast, all but one hamster (CpG, SC) developed antibody titers ranging from 1:10-1:160 after the first vaccination. Moreover, there was an increase of antibody response in all but one of the vaccinated hamsters ranging from 1:40-223 1:1280. Two Solavax-treated hamsters (IM) had a detectable titer of 1:80 and 1:160 after first vaccination but no detectable titer after booster vaccination. Booster vaccination in general increased the titer of neutralizing antibodies prior to virus challenge. In comparing all vaccinated groups, CpG (IM) had the highest mean titer after both the prime and the booster vaccination.

Taken together, these data indicate that the inactivated SARS-CoV-2 vaccine produces a high neutralizing antibody titer in vivo, and that viral titer can be significantly increased after a booster dose.

Figure 32B:
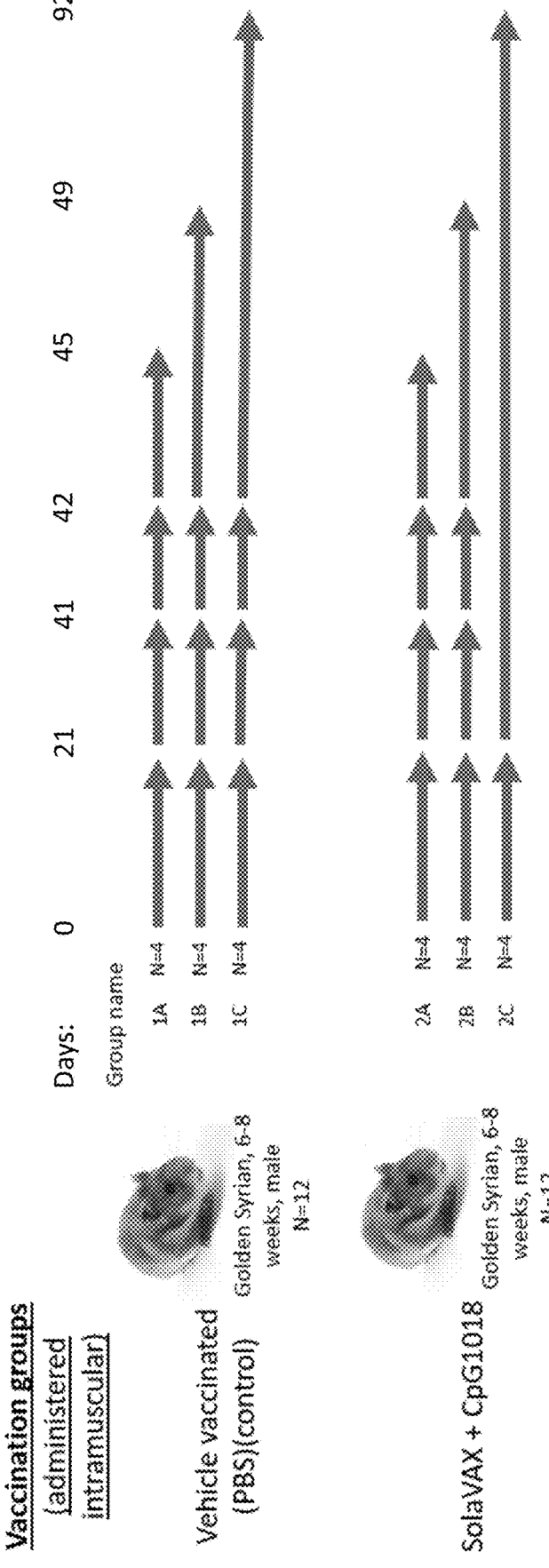
FIG. 32B shows vaccination groups tested.

To confirm the results of the first in vivo study (described in Example 4, and above in Example 5), and also evaluate the ability of the inactivated SARS-CoV-2 viral vaccine to cause antibody production long term, the study was repeated (referred to herein as the second in vivo study or the second challenge study). Hamsters in various treatment groups (FIG. 32B) were treated according to the protocol shown in FIG. 32A. In one group of animals, inoculation/challenge with live virus was performed after 42 days. In a second group (HOLD), animals were held for 92 days before being challenged with live virus.

Figure 33:
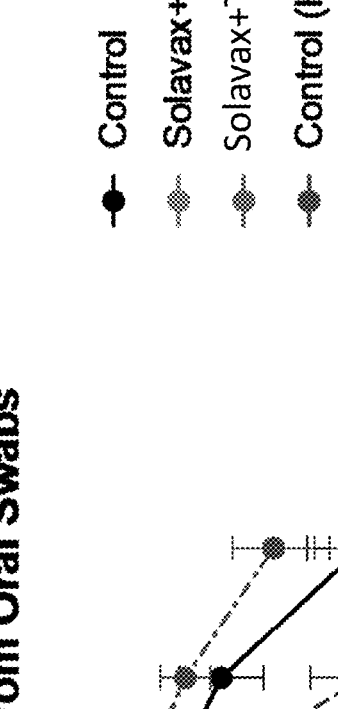
FIG. 33 shows viral titers from oral swabs in unvaccinated hamsters (control), hamsters vaccinated with inactivated SARS-CoV-2 viral vaccine plus the CpG1018 adjuvant (SolaVAX+CpG 1018), and hamsters vaccinated with inactivated SARS-CoV-2 viral vaccine plus an adjuvant capable of eliciting a Th1-type immune response (Solavax+Th1-type adjuvant) in the second challenge study. The groups labeled HOLD were vaccinated at day 0, but not challenged with virus until day 92. The other groups shown were vaccinated at day 0, and challenged with virus at day 42.
Figure 34:
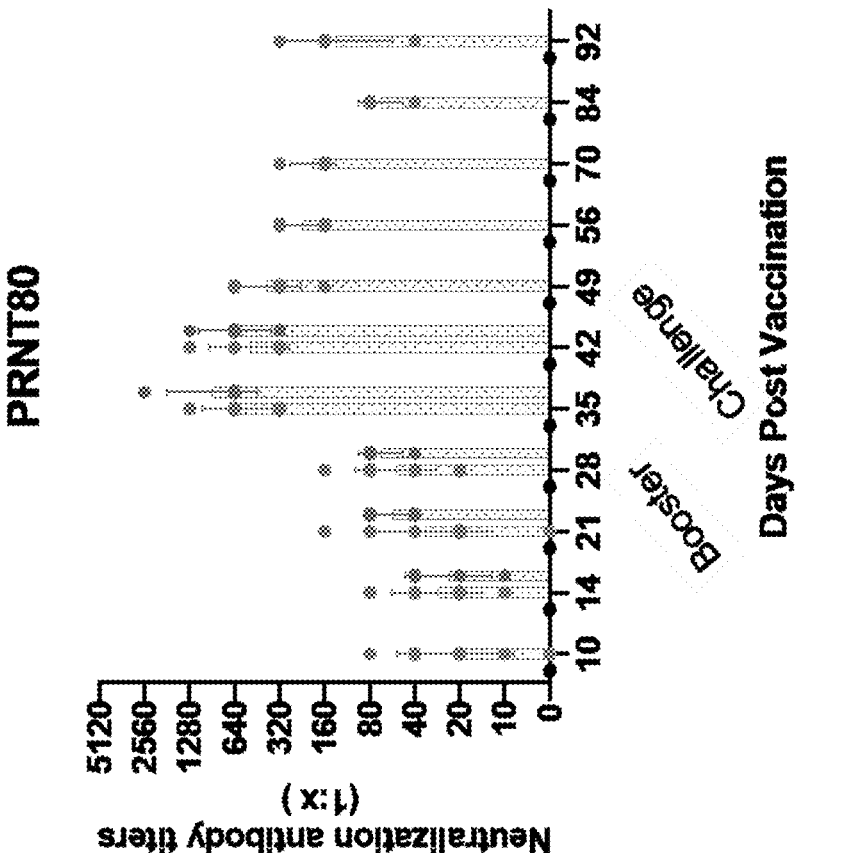
FIG. 34 shows PRNT80 titers at various days post vaccination in the second challenge study, in unvaccinated hamsters (control), hamsters vaccinated with inactivated SARS-CoV-2 viral vaccine plus the CpG1018 adjuvant (SolaVAX+CpG 1018), and hamsters vaccinated with inactivated SARS-CoV-2 viral vaccine plus a different adjuvant capable of eliciting a Th1-type immune response (Solavax+ Th1-type adjuvant).

Results are shown in FIG. 33-35. FIG. 33 shows viral titers in hamsters vaccinated and then challenged with SARS-CoV-2 after 42 days, or after 92 days (HOLD). The results demonstrate that although the protection was reduced at the longer interval (in the HOLD group), it was still present and led to lower levels of viremia were observed compared to the non-vaccinated animals.

In FIG. 34, overall antibody titers were measured post vaccination and boost to day 42 in samples from animals vaccinated with SolaVAX and a different Th1 promoting adjuvant, and to day 92 in samples from animals vaccinated with SolaVAX plus the CpG1018 adjuvant (also a Th1-promoting adjuvant). The data shows that antibody persists over time after vaccination and boost. Although somewhat reduced, neutralizing antibody is still present at Day 92. A similar experiment was conducted using a vaccine composition comprising inactivated SARS-CoV-2 and an adjuvant that does not elicit a Th1-type immune response (data not shown). Notably, in this experiment, viremia was higher and neutralizing antibody titer was markedly lower than in experiments wherein an adjuvant capable of promoting a Th2-type immune response was used.

FIG. 35 shows viral titer in various tissues, in the groups challenged 42 or 92 days after vaccination. The data once again shows that vaccination and boost leads to reduce viral production and shedding from tissues. The HOLD group also shows that protection is still afforded even after 92 days in the vaccinated group.

Taken together these results show that protection 92 days after vaccination, although reduced from the earlier challenge data, was still provided at this extended period after vaccination and boost, relative to unvaccinated animals. The day 92 challenge group (HOLD) shows reduced levels of protection but still significant reductions in virus production in tissues compared to untreated animals, demonstrating the persistence of protection by the vaccine and consistent with the persistence of neutralizing antibody levels at significant intervals after vaccination and boost.

The data observed for CpG1018 adjuvant in this second in vivo study are consistent with results observed in the first challenge study when animals were challenged at Day 42. The data from these animals and the hold group shows reduced viral titer production in tissues and generation of neutralizing antibody titers. This study also tested an additional Th1 promoting adjuvant for its ability to induce better immune response, which was not observed when an adjuvant not capable of promoting a Th1 response was used.

Example 6: Inactivated SARS-CoV-2 Viral Vaccine Produces Antibodies Directed Against the SARS-CoV-2 S1 Protein, S2 Protein, and Receptor Binding Domain In Vivo An ELISA-based assay was used to determine the targets of the antibodies produced in hamsters after immunization (see Example 5). Specifically, the ELISA was performed to evaluate antibody binding to SARS-CoV-2 spike protein region S1 (amino acids 16-685), S2 (amino acids 686-1213), and RBD (amino acids 319-541) (all recombinant proteins from SinoBiological, Wayne, PA). Briefly, high binding 96-well plates (Corning, St. Louis, MO) were coated with 50 ng of S1, S2, and RBD protein prepared in PBS and incubated overnight at 4° C. Plates were washed 5 times with PBS+0.05% Tween 20 (Sigma, St. Louis, MO) and incubated with blocking buffer (PBS+2% BSA+2% normal goat serum+0.05% Tween 20) for 2 hours at room temperature (RT). Serial dilutions (1/250, 1/1250, and 1/6250) of serum obtained from naïve, non-vaccinated and vaccinated hamsters were prepared in blocking buffer and added to the plates for 1 hour. After washing, 1:10,000 dilution of HRP conjugated anti-533 hamster IgG (H+L) secondary antibody (Jackson Immuno Research, 107-035-142) prepared in blocking buffer was added and incubated for 1 hour. Plates were washed, TMB substrate (ThermoFisher, Waltham, MA) added, and the reaction was stopped after 10 minutes by adding 1M $H_2SO_4$. Absorbance was measured at 450 nm using a Biotek Synergy 2 plate reader (Winnoski, VT). Pooled serum from naïve hamsters was used as a negative control.

A strong IgG response against the three viral proteins was detected in infected hamsters previously vaccinated with SolaVAX (FIG. 18A-18C). In contrast, IgG levels against viral proteins were below the detection limit in hamsters in the Control group. The following trend was observed for all vaccinated hamsters regardless of vaccination route: a) Titers against the S1 protein and RBD subunit were higher than against the S2 protein; b) IgG levels were greater in infected hamsters vaccinated with SolaVAX, followed by ODN and CpG groups. The bottom panel in each of FIG. 18A-18C shows values for individual hamsters as an area under the curve. These findings were wholly unexpected, based on the finding that overall viral titers (PRNT90) varied among vaccination groups (FIG. 10A-10B). For example, as shown in FIG. 10A-10B, the titers of total antibody in the no adjuvant (SolaVax) group were significantly lower than the titers for the inactivated vaccine+CpG1018 group (Sola-Vax+CoG1018), after intramuscular injection. However, the levels of anti-RBD binding domain antibodies and anti-S1 protein antibodies in these groups were roughly equal (See FIG. 18A and FIG. 18C). This data indicates that the use of an adjuvant in the vaccine may increase the total amount of antibodies produced after vaccination, but it does not increase the titer of antibodies specifically directed to the RBD or S1 protein.

Notably, animals vaccinated with the inactivated vaccine without adjuvant (SolaVax) and animals vaccinated with inactivated vaccine+CpG1018 (SolaVax+CoG1018) had similar viral titers in various tissues after challenge with SARS-CoV2 (see arrows in FIG. 9A-9F). Taken together, this data indicates that generation of a high antibody titer does not necessarily lead to neutralizing efficacy (i.e., not all antibodies are "created equal"), and that that neutralizing antibodies alone are not solely responsible for the enhanced protection. This data surprisingly indicates that production of a threshold level of antibodies directed against, for example, the RBD and the S1 protein, is sufficient to neutralize SARS-CoV-2. The inactivated viral vaccines described herein are capable of producing the requisite level of such antibodies, with or without adjuvant.

Figure 16:
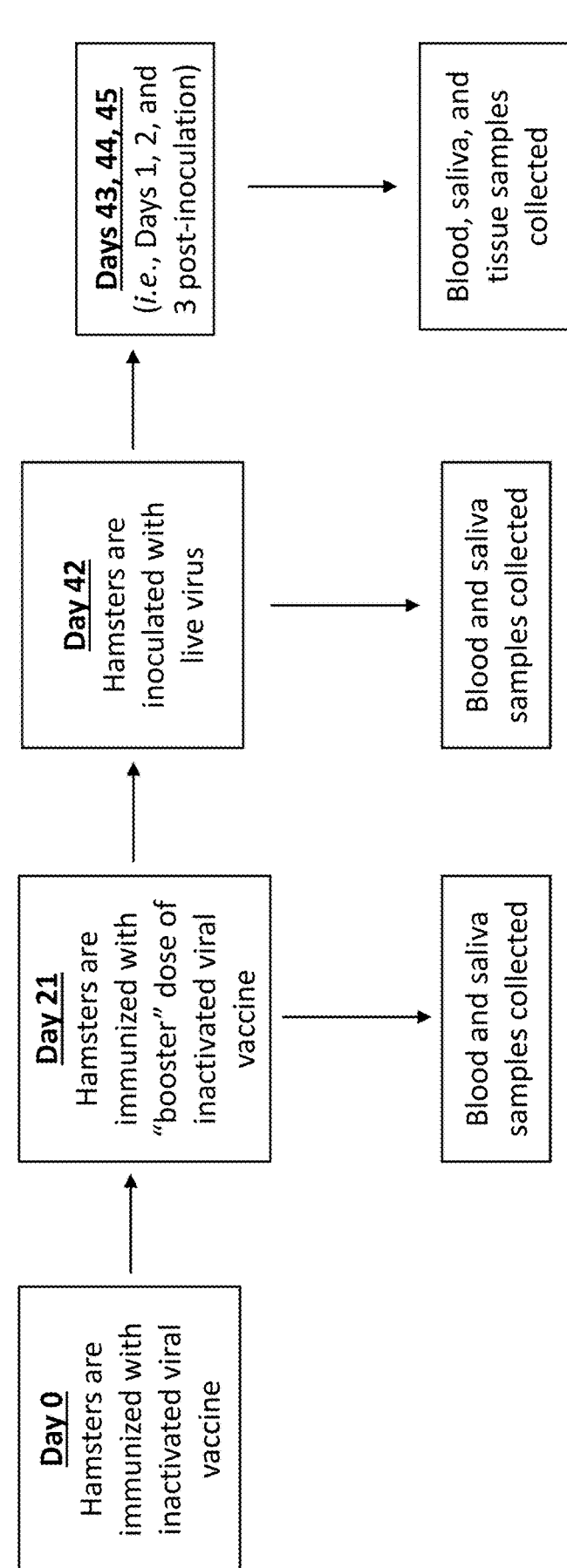
FIG. 16 is a schematic showing the in vivo immunization protocol used in the first in vivo study, described below.

Example 7: Inactivated SARS-CoV-2 Vaccine Increases Levels of Circulating Leukocytes In Vivo The immunological response elicited upon SARS-CoV-2 infection of control or vaccinated animals was evaluated by flow cytometry analysis of leukocytes obtained from lungs, spleen and blood. Hamsters were immunized as shown in FIG. 16. At 3 DPI (day 45), the animals were sacrificed and blood and tissue samples were obtained. These tissues were disrupted to produce single cell suspensions. The cells were contacted with primary antibodies against various markers as shown in Table 5. Briefly, $2\times10^6$ cells were added into each well of a 96-well v-bottom plate and incubated with 1× Brefeldin A at 37° C. for 4 hours. Cells were washed and stained with Zombie NIR live/dead stain, washed and further stained with predetermined optimal titrations of specific surface antibodies (Table 5) and fluorescence minus one (FMOs). For intracellular staining, cells were further incubated with 1× Foxp3 Perm/Fix buffer (eBiosciences, San Diego, CA) for 1 hour at 37° C., washed with 1× permeabilization buffer (eBiosciences, San Diego, CA) twice and stained with intracellular antibodies cocktail (prepared in 1× permeabilization buffer) and respective FMOs overnight at 4° C. The next day, cells were washed twice and resuspended in 300 μL of 1× Permeabilization buffer. Samples were acquired using a Cytek Aurora™ spectral flow cytometer where 100,000 events were recorded.

TABLE 5

| Flow Cytometry Panel | | | | | |
| --- | --- | --- | --- | --- | --- |
| Antibody | Clone | Fluorophore | Concentration of Antibody Used | Company | Catalogue |
| CD4 | GK1.5 | Pacific Blue | 1 μg/mL | Biolegend ® | 100428 |
| CD8 | 341 | FITC | 2 μg/mL | BD Biosciences ® | 554973 |
| IFN-gamma | XMG1.2 | BV785 | 1 μg/mL | Biolegend ® | 505838 |
| IL-10 | JES6-16E3 | BV421 | 1 μg/mL | Biolegend ® | 505022 |
| GATA-3 | 16E10A23 | PE | 0.5 μg/mL | Biolegend ® | 653804 |
| Tbet | 4B10 | BV711 | 0.5 μg/mL | Biolegend ® | 644820 |
| IL-4 | 11-B11 | APC | 1 μg/mL | Biolegend ® | 504106 |
| TNF-alpha | MPS-XT22 | PE-Dazzle 594 | 0.5 μg/mL | Biolegend ® | 506346 |
| IL-6 | MP5-20F3 | Percp eflour 710 | 1 μg/mL | Thermo Scientific ® | 46-7061-82 |

TABLE 5-continued

| Flow Cytometry Panel | | | | | |
|---|---|---|---|---|---|
| Antibody | Clone | Fluorophore | Concentration of Antibody Used | Company | Catalogue |
| CXCR3 | 173 | APC-Fire 750 | 1 µg/mL | Biolegend ® | 126540 |
| CXCR4 | 2B11 | BV650 | 2 µg/mL | BD Biosciences ® | 470526 |
| Zombie NIR | | Live/Dead | 1:2000 dilution | Biolegend ® | 423106 |

The immunological response elicited upon SARS-CoV-2 infection of control or vaccinated animals was evaluated by flow cytometry analysis of leukocytes obtained from lungs, spleen and blood. Populations classified as having statistically significant differences in the total numbers of each cell type present in the lung/spleen or blood between groups are shown in FIGS. 11A-11B, 12A-12B, 13A-13B.

Figure 11A:
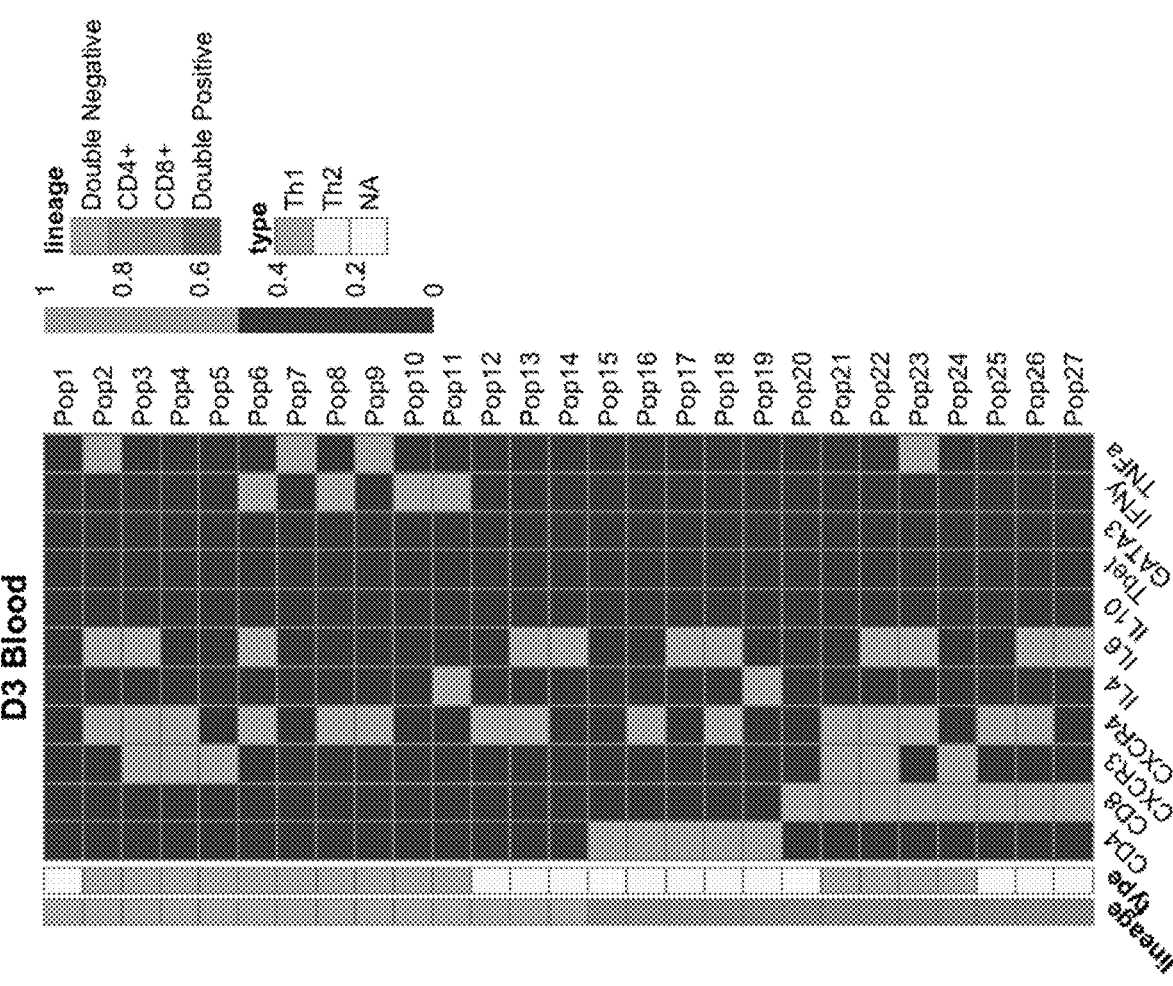
Figure 12A:
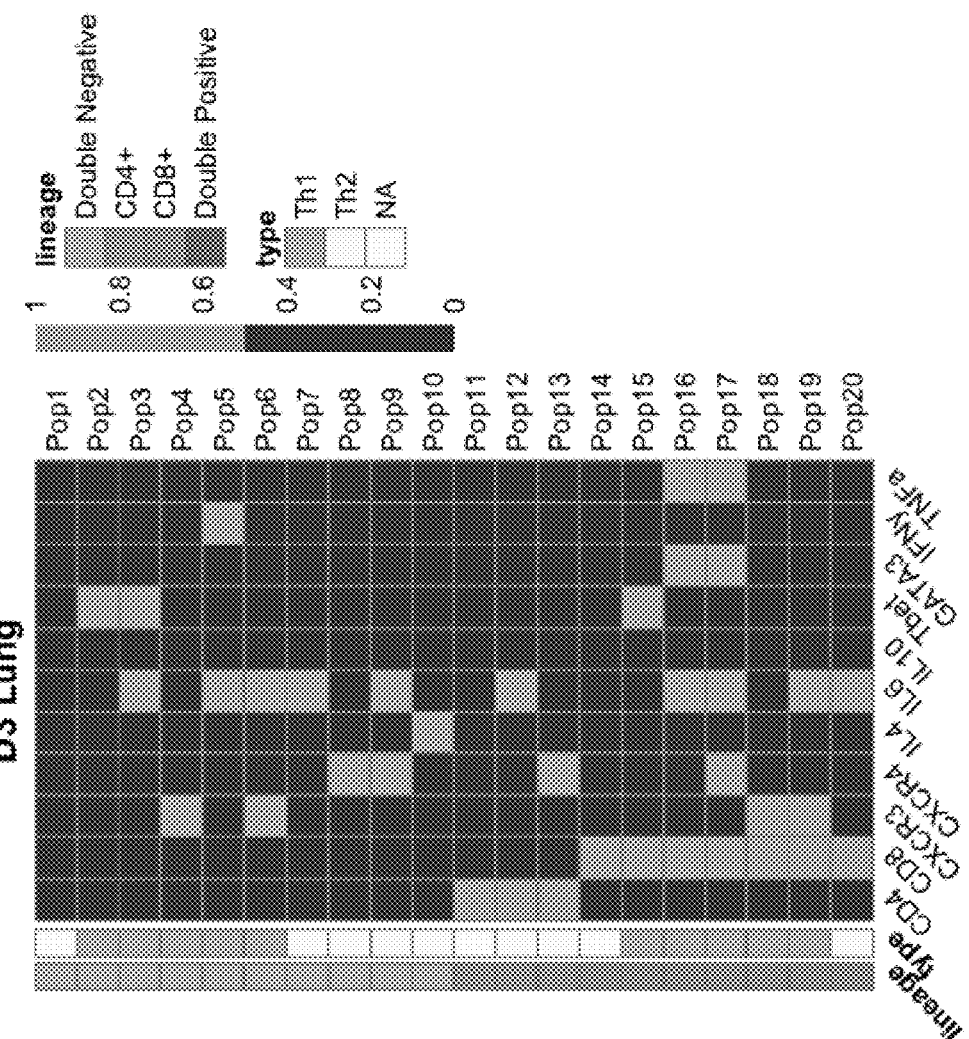
FIG. 12A-12B shows statistically significant flow cytometry populations in blood within intramuscular and subcutaneously vaccinated groups.
Figure 12B:
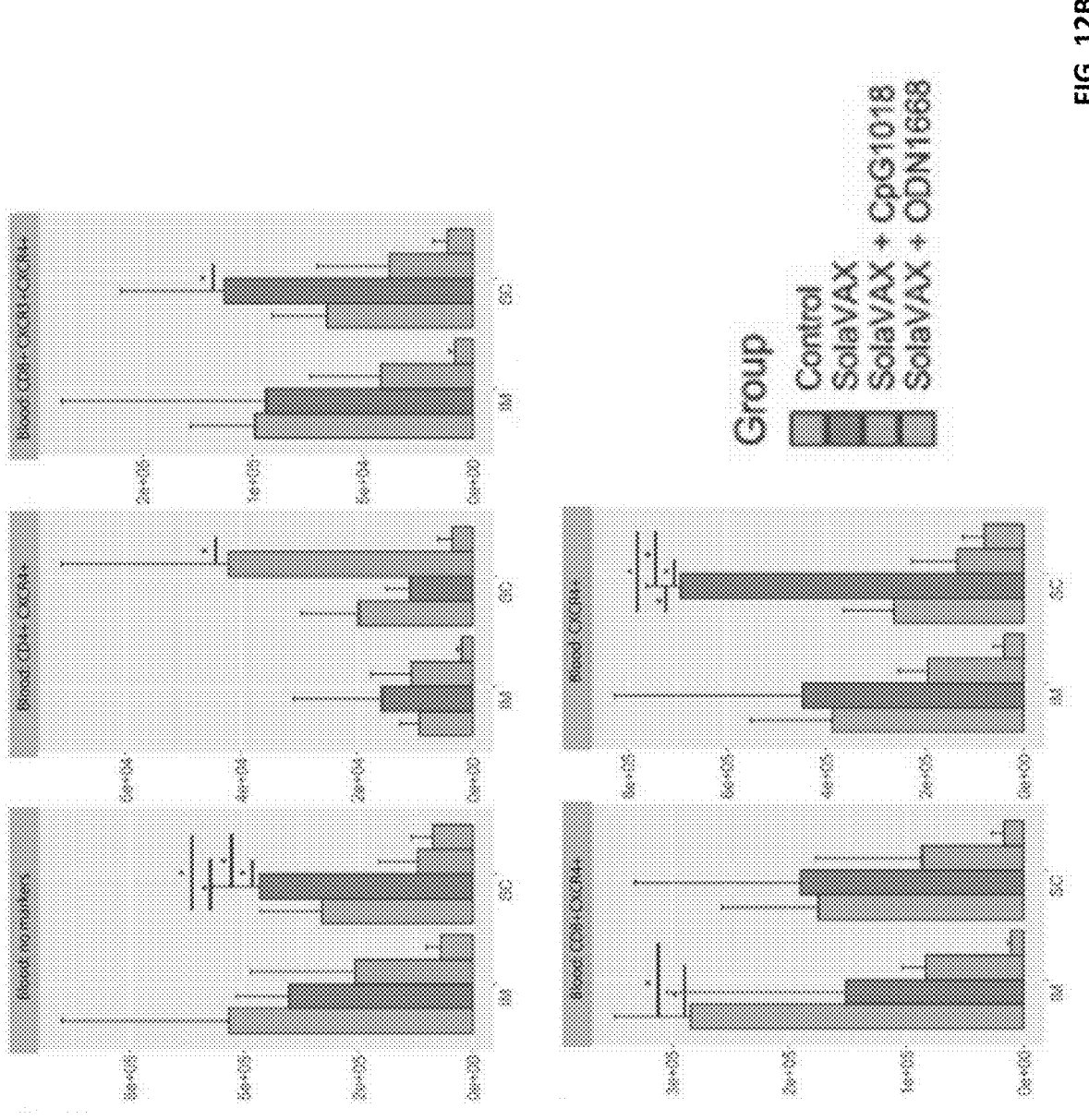

The lung samples were divided into 20 leukocyte populations by gating for marker expression, as shown in FIG. 12A and Table 7. In the lungs, the SC Control group had significantly more cells expressing inflammatory markers (IL-6) and (IL-6 and CXCR4) than any of the other subcutaneously vaccinated groups (FIG. 11B). The CpG SC group also had significantly fewer cells associated with a Th2 response (CD8+ IL-6+ GATA3+ CD4– CXCR3– CXCR4– IL-4– IL-10– Tbet– IFN-γ– TNF-α–) compared to the SolaVAX vaccinated group. These cells may be involved in the induction of isotype switching in the host as a result of the increased infection in the Control group. The vaccine appears to shift the immune response away from an anti-inflammatory Th2 response.

The blood samples were divided into 27 leukocyte populations by gating for marker expression, as shown in FIG. 11A and Table 6. In the blood, the SolaVAX-vaccinated IM groups with adjuvants had significantly lower numbers of CD8+ CXCR4+ CD4–CXCR3– IL-6– Tbet– IFN-γ– IL-4– IL-10– GATA– TNF-α– cells compared to the Control group (FIG. 12). These cells may promote inflammatory cytokine expression and cell chemotaxis through the MAPK pathway.

Figure 13A:
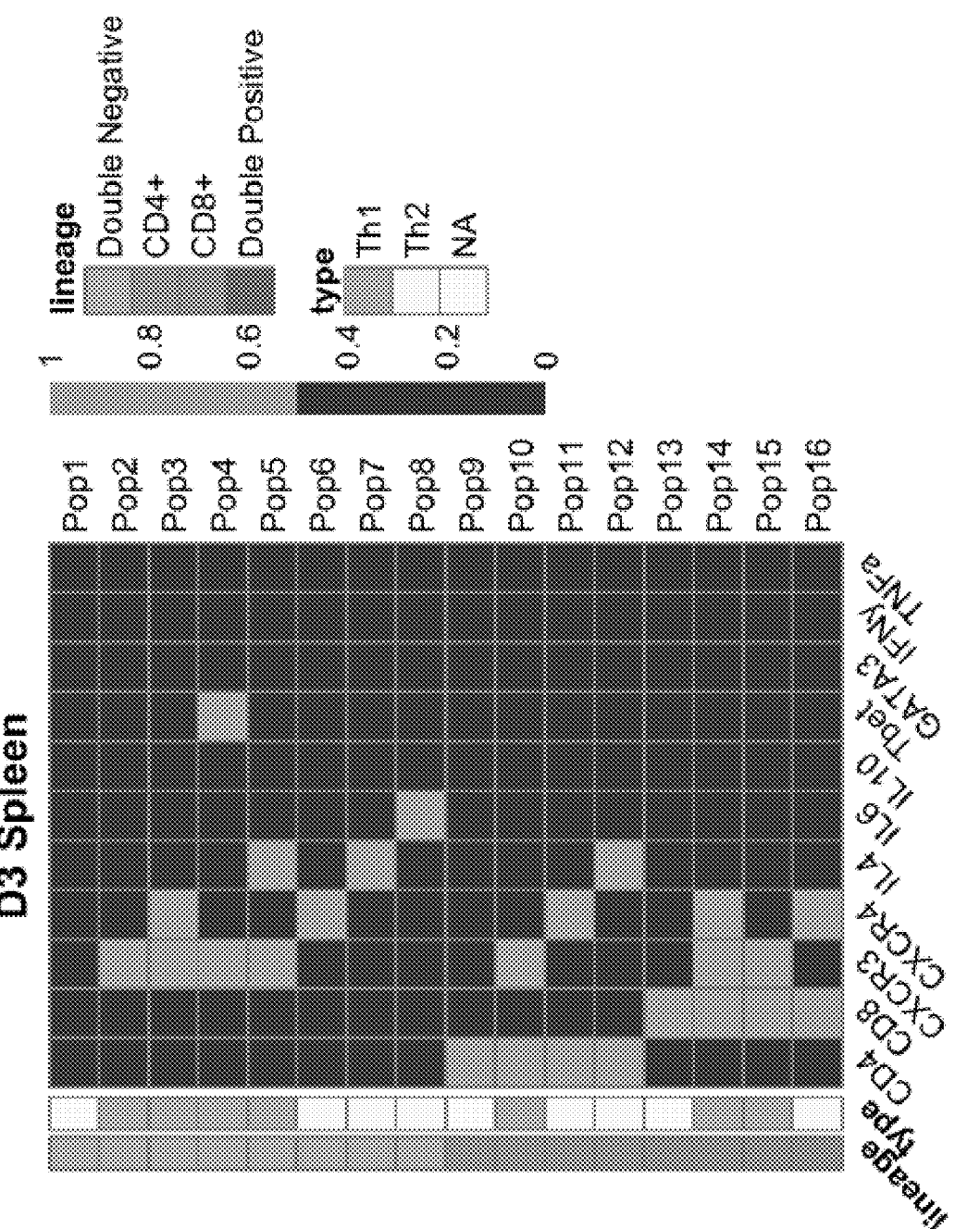
Figure 26A:
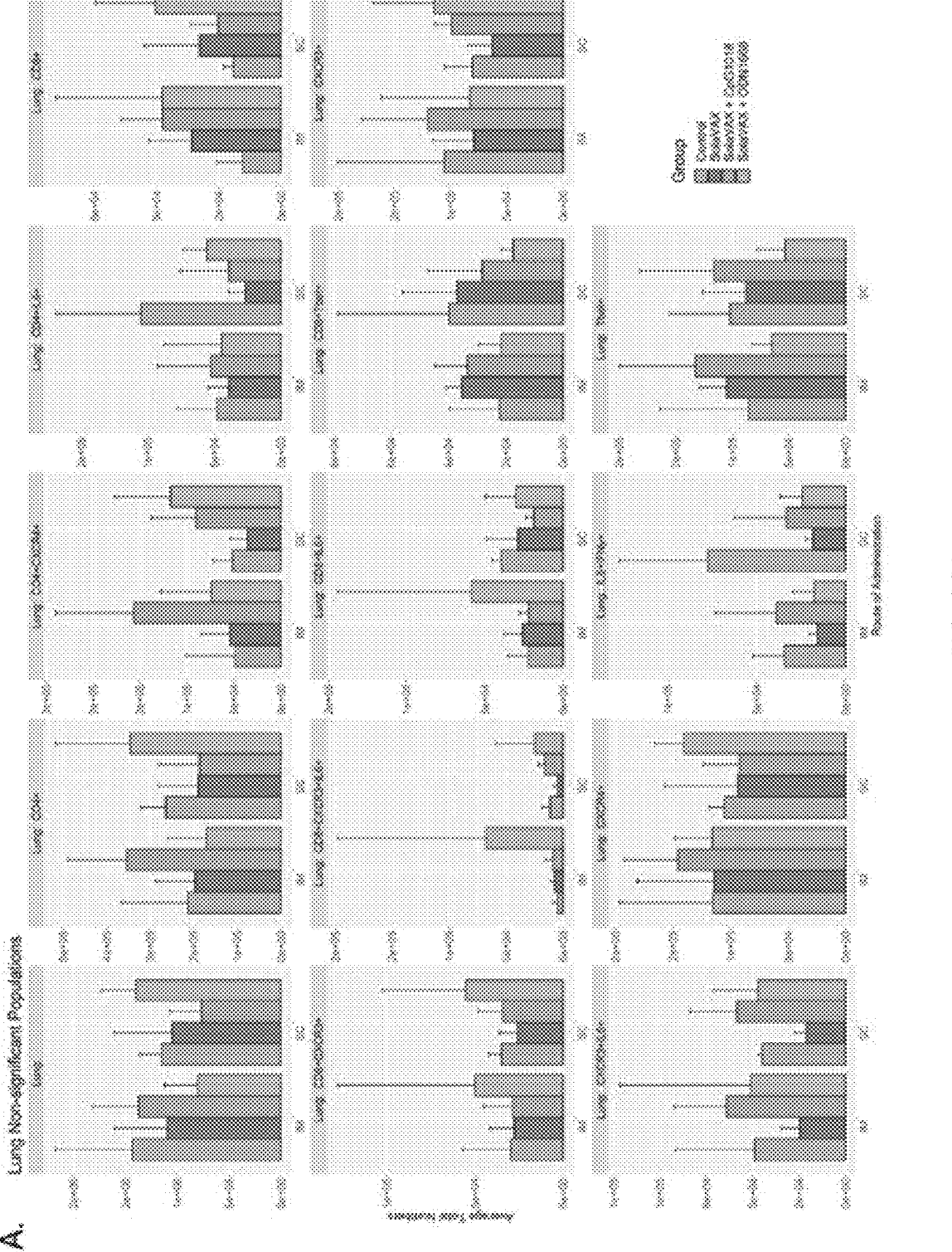
FIG. 26A-26C shows statistically non-significant flow cytometry populations within intramuscular and subcutaneously vaccinated groups. The bar plots show the statistically non-significant populations for the lung (FIG. 26A), spleen (FIG. 26B), and blood (FIG. 26C). The y-axis displays the average total numbers of cells for the eight groups. The population names at the top of the plots indicate the positive markers in the population: the population is negative for all other markers in the panel. The groups are shown, from left to right, Control, SolaVax, SolaVax+CpG1018, SolaVax+ ODN 1688.
Figure 26B:
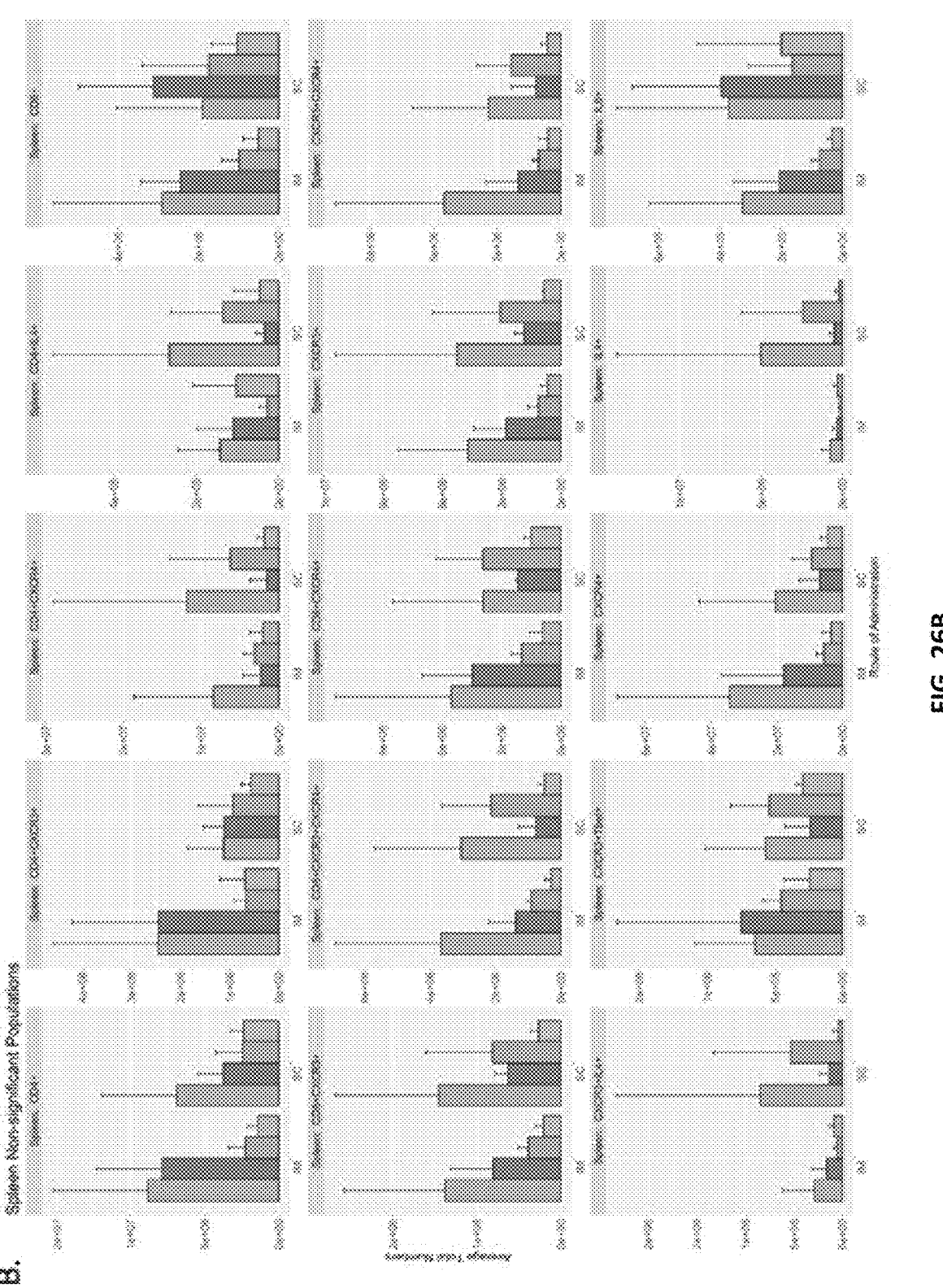
Figure 26C:
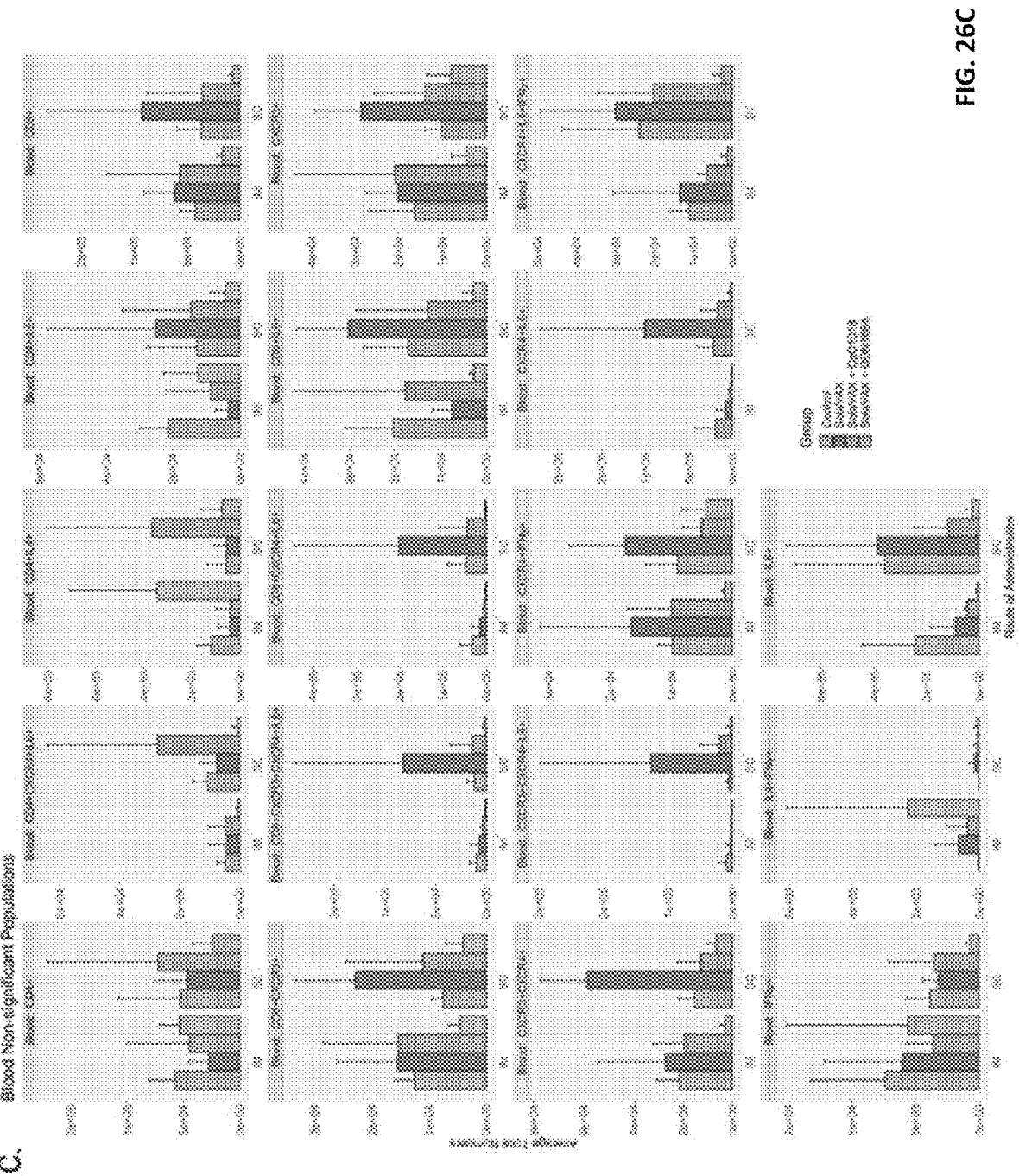

The spleen samples were divided into 16 leukocyte populations by gating for marker expression, as shown in FIG. 13A and Table 8. In the spleen, the Control group had significantly higher numbers of proinflammatory cells expressing CXCR4+ IL-6+ Tbet+ IFN-γ+ CD4– CD8– CXCR3– IL-4– IL-10– GATA– TNF-α– cells than the vaccinated groups (FIG. 13B). Non-significant populations for all organs are shown in FIG. 26A-26C. The samples were then analyzed using flow cytometry according to a standard protocol, to determine the relative levels of TH1 and TH2 leukocytes in each tissue. In general, the following markers were considered to be Th markers: CXCR3, IFN, Tbet, TNF-alpha, and the following markers were considered to be Th2 markers: IL-6, IL-6, IL-4, CXCR4, GATA3. All cells were gated on singlets, leukocytes, and live cells.

TABLE 6

| Leukocyte populations in blood, based on marker expression | |
|---|---|
| Population No. | Marker(s) |
| 1 | None |
| 2 | CXCR4, IL6, TNF-alpha |

TABLE 6-continued

| Leukocyte populations in blood, based on marker expression | |
|---|---|
| Population No. | Marker(s) |
| 3 | CXCR3, CXCR4, IL6 |
| 4 | CXCR3, CXCR4 |
| 5 | CXCR3 |
| 6 | CXCR4, IL6, IFN |
| 7 | TNF-alpha |
| 8 | CXCR4, IFN |
| 9 | CXCR4, TNF-alpha |
| 10 | IFN |
| 11 | IL4, IFN |
| 12 | CXCR4 |
| 13 | CXCR4, IL6 |
| 14 | IL6 |
| 15 | CD4 |
| 16 | CD4, CXCR4 |
| 17 | CD4, IL6 |
| 18 | CD4, CXCR4, IL6 |
| 19 | CD4, IL4 |
| 20 | CD8 |
| 21 | CD8, CXCR3, CXCR4 |
| 22 | CD8, CXCR3, CXCR4, IL6 |
| 23 | CD8, CXCR4, IL6, TNF-alpha |
| 24 | CD8, CXCR3 |
| 25 | CD8, CXCR4 |
| 26 | CD8, CXCR4, IL6 |
| 27 | CD8, IL6 |

TABLE 7

| Leukocyte populations in lung, based on marker expression | |
|---|---|
| Population No. | Marker(s) |
| 1 | None |
| 2 | Tbet |
| 3 | IL6, Tbet |
| 4 | CXCR3 |
| 5 | IL6, IFN |
| 6 | CXCR3, IL6 |
| 7 | IL6 |
| 8 | CXCR4 |
| 9 | CXCR4, IL6 |
| 10 | IL4 |
| 11 | CD4 |
| 12 | CD4, IL6 |
| 13 | CD4, CXCR4 |
| 14 | CD8 |
| 15 | CD8, Tbet |
| 16 | CD8, IL6, GATA3, TNF-alpha |
| 17 | CD8, CXCR4, IL6, GATA3, TNF-alpha |
| 18 | CD8, CXCR3 |

45

TABLE 7-continued

Leukocyte populations in lung,
based on marker expression

| Population No. | Marker(s) |
|---|---|
| 19 | CD8, CXCR3, IL6 |
| 20 | CD8, IL6 |

TABLE 8

Leukocyte populations in spleen,
based on marker expression

| Population No. | Marker(s) |
|---|---|
| 1 | None |
| 2 | CXCR3 |
| 3 | CXCR3, CXCR4 |
| 4 | CXCR3, Tbet |
| 5 | CXCR3, IL4 |
| 6 | CXCR4 |
| 7 | IL4 |
| 8 | IL6 |
| 9 | CD4 |
| 10 | CD4, CXCR3 |
| 11 | CD4, CXCR4 |
| 12 | CD4, IL4 |
| 13 | CD8 |
| 14 | CD8, CXCR3, CXCR4 |
| 15 | CD8, CXCR3 |
| 16 | CD8, CXCR4 |

Taken together, these data indicate that the inactivated SARS-CoV-2 vaccine increases levels of circulating leukocytes in vivo, and also increases levels of the types of leukocytes in various tissues that promote a Th1-type response.

Example 8: Inactivated SARS-CoV-2 Vaccine Decreases Expression of Genes Involved in the Inflammatory Response Single-cell RNA sequencing (scRNAseq) methodology was used to determine what effect, if any, the inactivated viral vaccines had on expression on various inflammatory markers in lung cells. This analysis allows examination of gene expression in cells of various different tissues (e.g., blood or spleen), to see how expression of genetic markers changes after infection. Data from this analysis may be used to determine how the inactivated viral vaccine protects or changes the cellular responses at the genetic level in different cell populations.

Figure 19B:
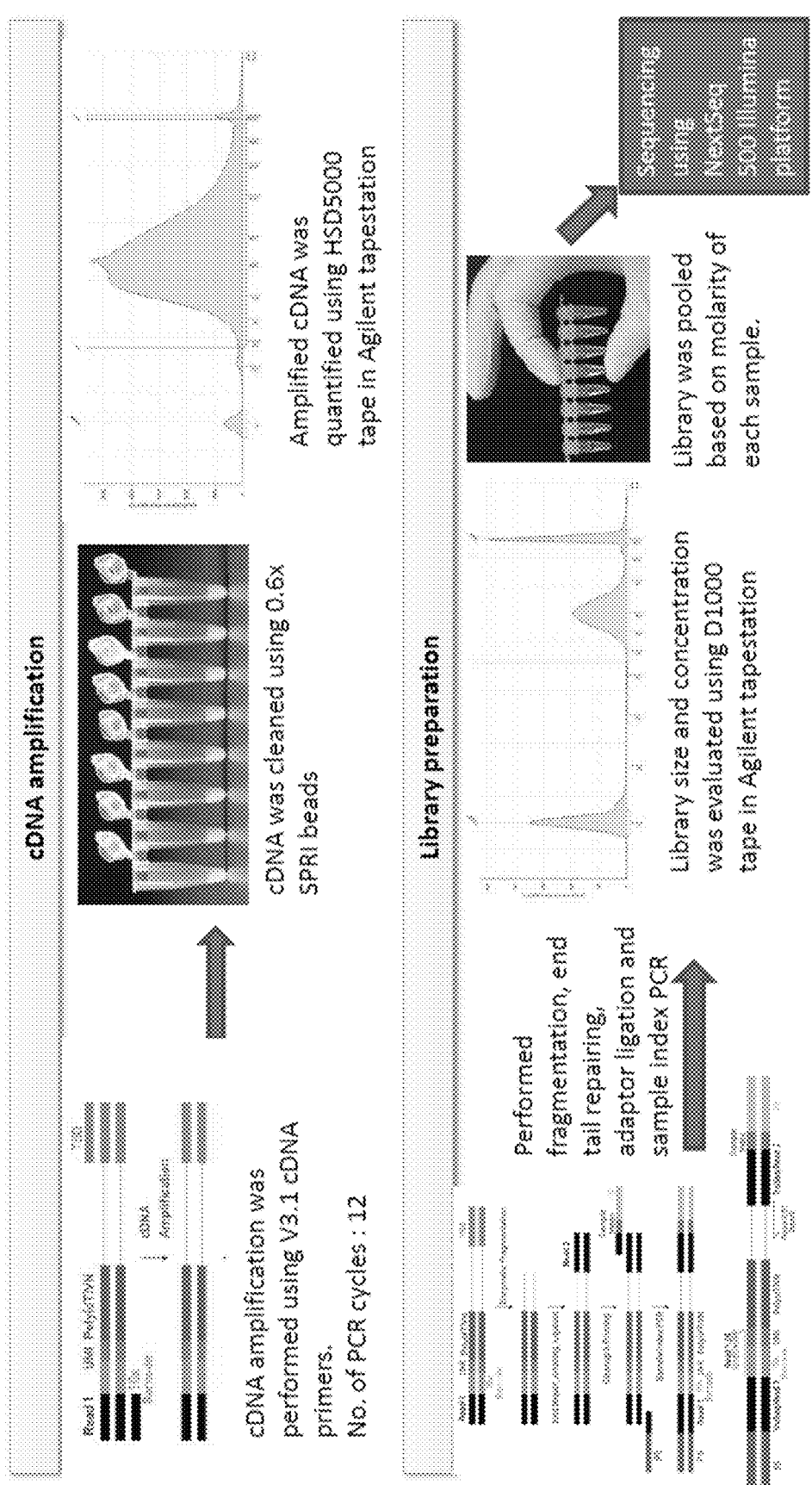

Lung tissue was harvested from a single hamster that had been immunized and challenged with SARS-CoV-2, as shown in FIG. 16. Single cell RNA sequencing was then performed according to the protocol shown in FIG. 19A-19B. Briefly, cells were prepared as described above, filtered, washed and resuspended in PBS+0.4% BSA. Cells were counted using a hemocytometer, and ~12,000 cells were added to the 10× Genomics chromium Next GEM Chip for a target recovery of 8,000 cells. GEMs were placed in a thermal cycler and cDNA purified using Dynabeads. cDNA amplification was done using 10× Genomics single cell v3' chemistry as per the manufacturer's recommendations. The amplification PCR was set at 11 cycles and to eliminate any traces of primer-dimers, the PCR amplified cDNA product was purified using 0.6×SPRI beads (Beckman Coulter)

Figure 30:
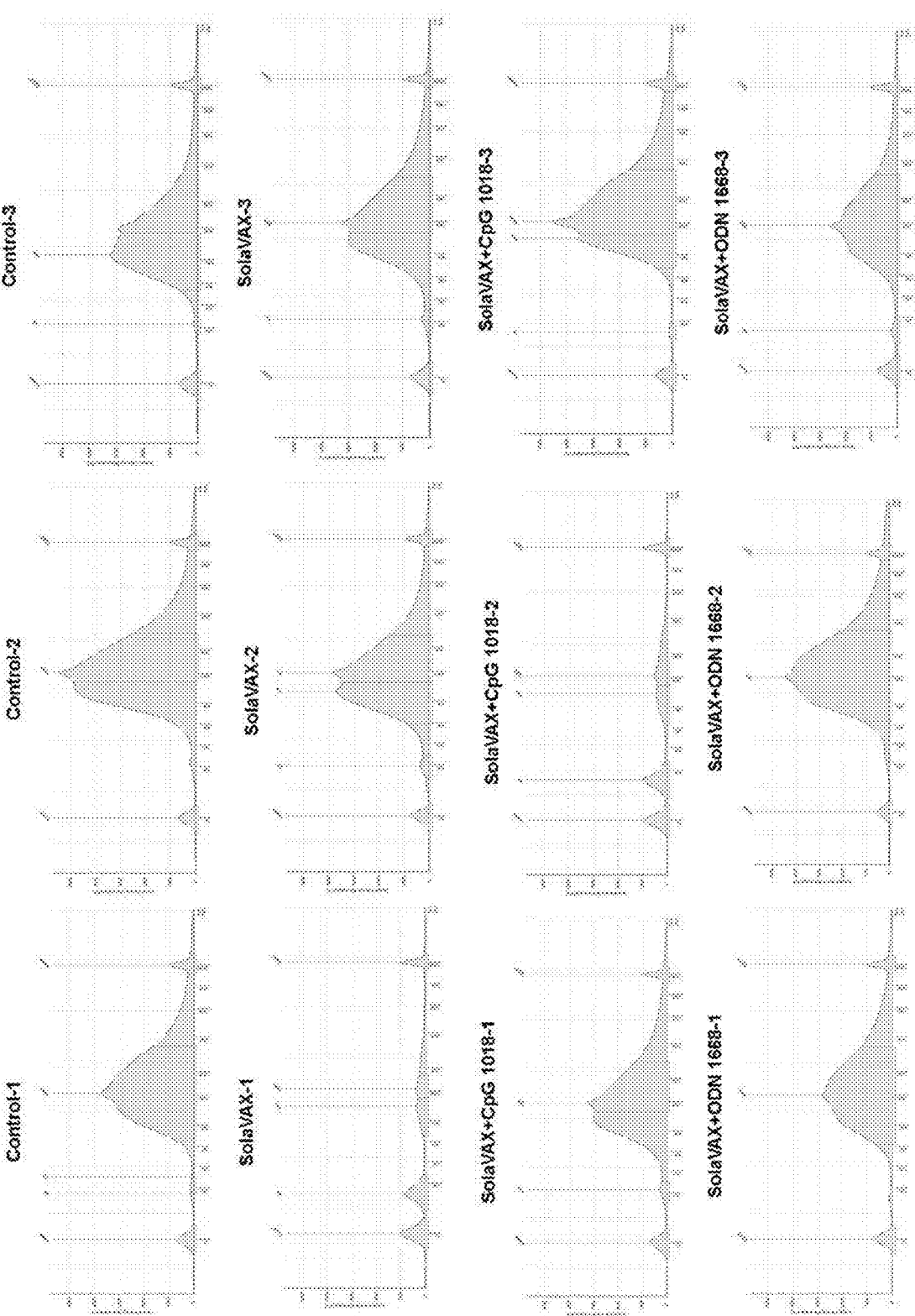
FIG. 30 provides illustrative cDNA amplification traces. cDNA was amplified and quality and quantity were evaluated via Agilent® Tapestation® using HS-D5000 screen tapes and reagents. Traces represent amplified cDNA after 10-fold dilution.
Figure 31:
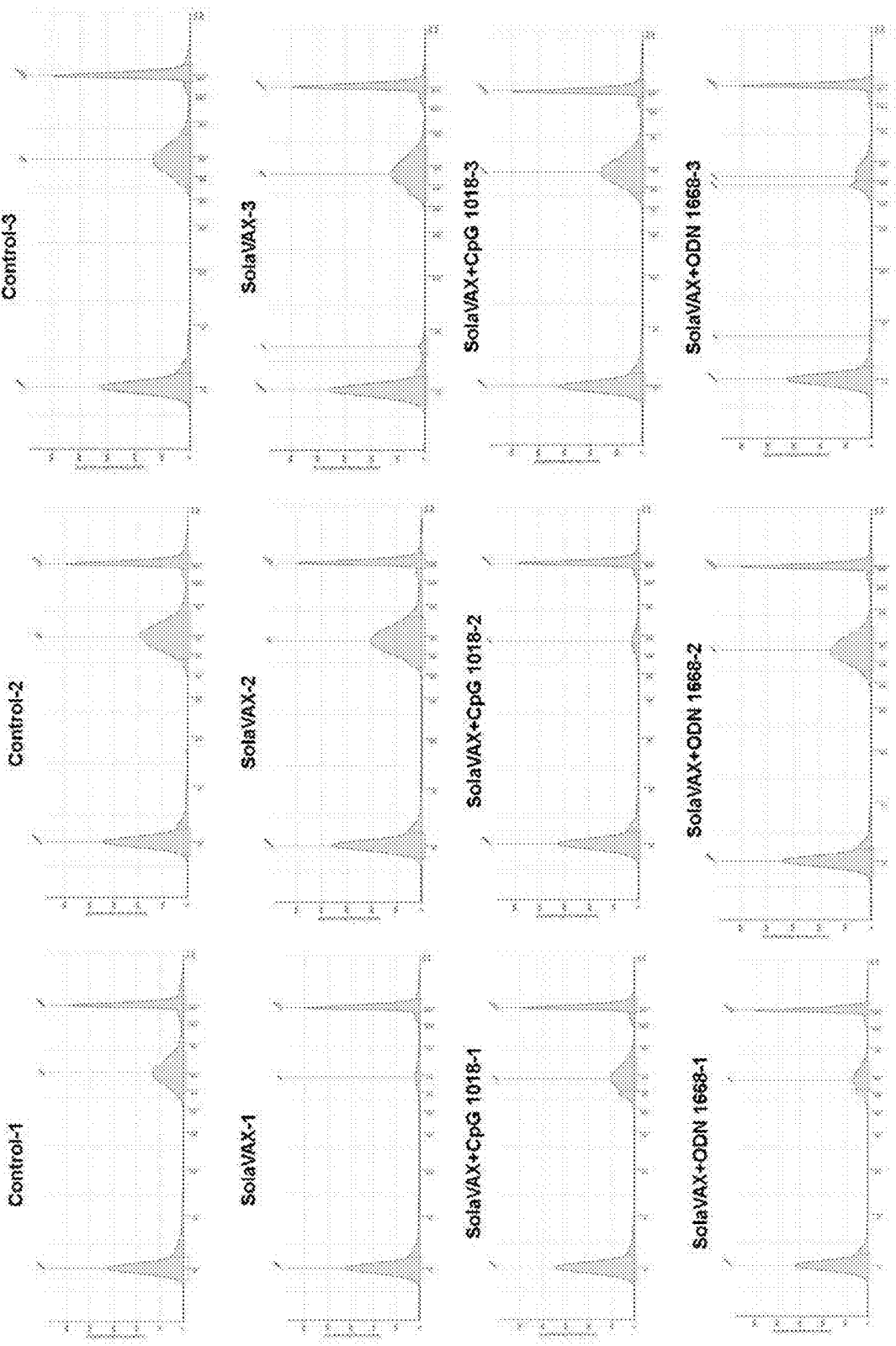
FIG. 31 shows illustrative cDNA library traces. cDNA was amplified, library was prepared, and quality and quantity were evaluated via Agilent® Tapestation® using HS-D1000 screen tapes and reagents. Traces here represent cDNA library after 10-fold dilution.

46 before using the DNA for sequencing library preparation. Quality and quantity of cDNA was determined via Agilent TapeStation analysis using a HS-D5000 screen tape (FIG. 30). Twenty-five percent (25%) of the total cDNA amount was carried forward to generate barcoded sequencing libraries with 10 cycle of Sample Index PCR in 35-mL reaction volume (FIG. 31). Libraries were then pooled at equal molar concentration (FIG. 27B) and sequenced on an Illumina® NextSeq 500 sequencer to obtain a total of 941M read pairs (Illumina). An average of 78M read pairs per sample were generated with a standard deviation of 10.7M read pairs. Low-quality cells with <200 genes/cell and cells that express mitochondrial genes in >15% of their total gene expression were excluded. Gene expression in each group was normalized based on the total read count and log transformed.

Sequenced samples were de-multiplexed using Cell Ranger mkfastq (Cell Ranger 10× Genomics, v3.0.2) to generate fastq files and aligned to the Mesocricetus auratus (accession GCA_000349665) and SARS-CoV-2 (reference genome MN985325) reference genomes using CellRanger count pipeline. Filtered barcode matrices were analyzed by Seurat package Version 3.0. Low quality cells, defined as expressing <200 genes/cell or those in which mitochondrial genes corresponded to >15% of their total gene expression, were excluded. Samples within groups were merged and downsampled to the same number of cells per group. Thereafter, gene expression for each group was normalized based on total read counts and log transformed. All groups were integrated using Seurat integration strategy, aligned samples scaled, and cells analyzed by unsupervised clustering (0.5 resolution), after principal components analysis (PCA). The top 15 principal components were visualized using UMAP. Differentially up-regulated genes in each cluster were selected with >0.25 log fold change and an adjusted $p<0.05$. Cell types were assigned by manually inspecting the top 20 upregulated genes, in addition to identifying previously published specific markers such as FSCN1 and GZMA for dendritic cells and CD8+ effector T cells, respectively. Differentially expressed genes (DEGs) between non-vaccinated group and vaccinated groups were identified using DESeq2 algorithm, with a Bonferroni-adjusted $p<0.05$ and a $\log_2$ fold change >1.

Figure 20A:
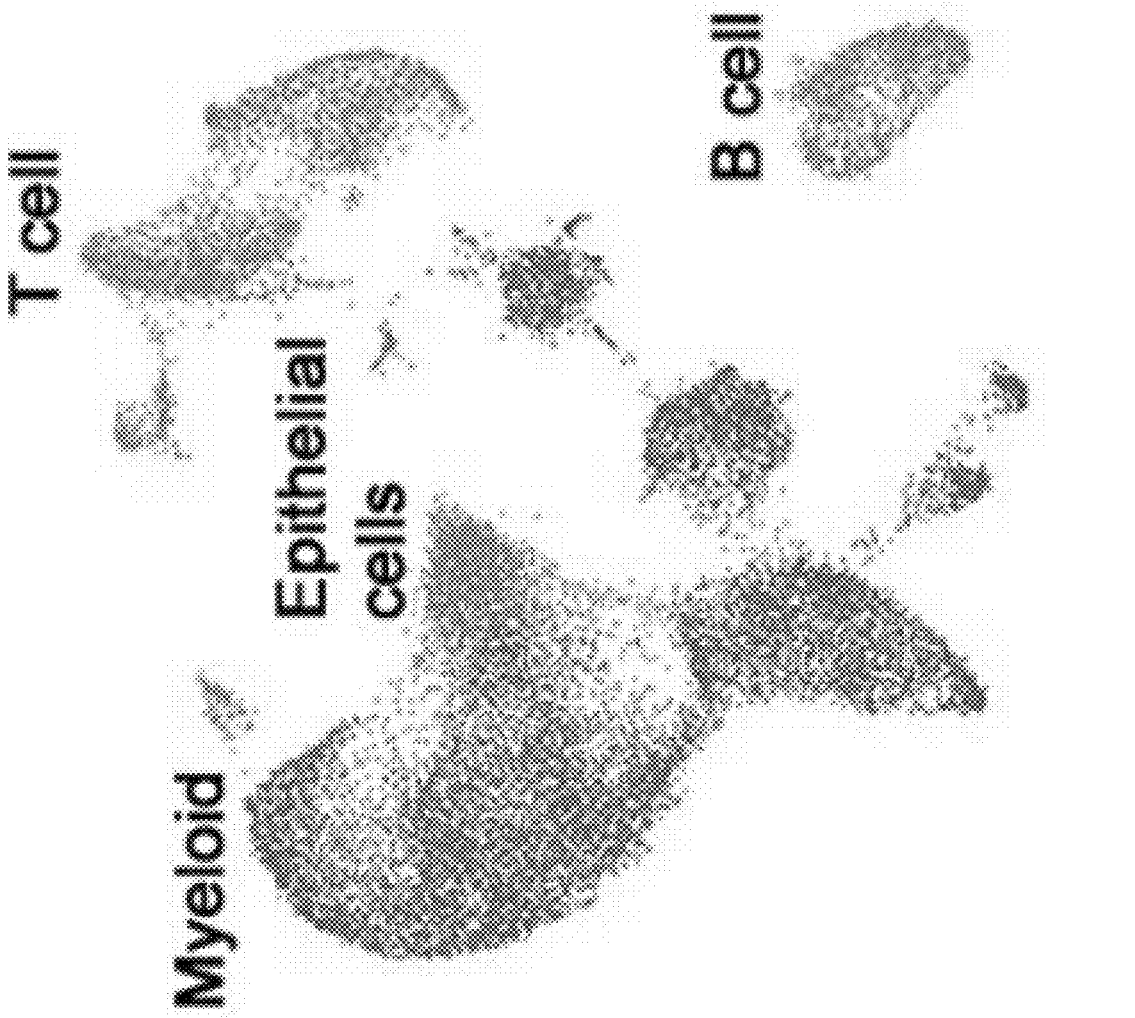
FIG. 20A-20G shows single cell transcriptomes of lungs from non-vaccinated and SolaVAX vaccinated hamsters.
Figure 20B:
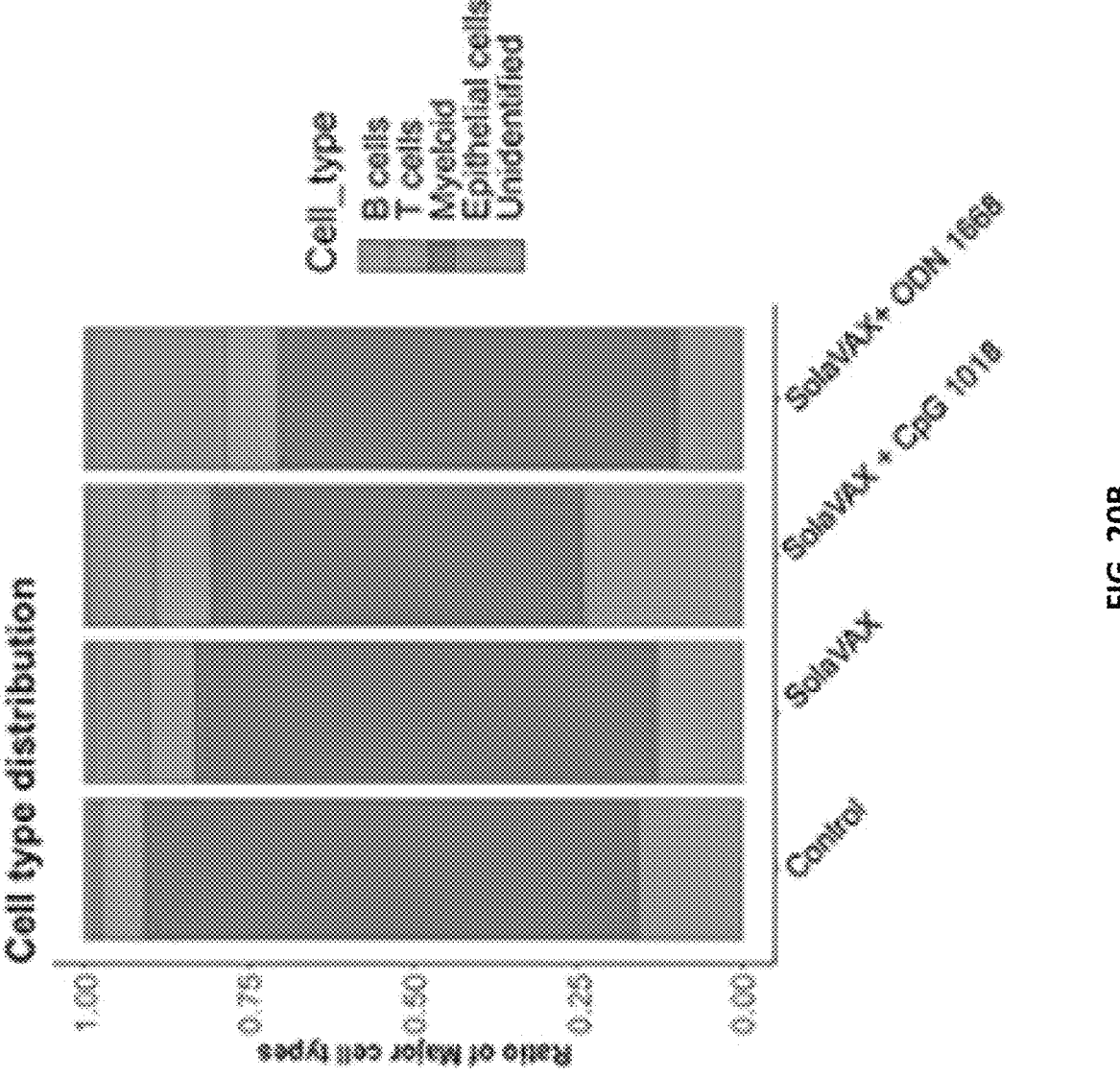
Figure 20C:
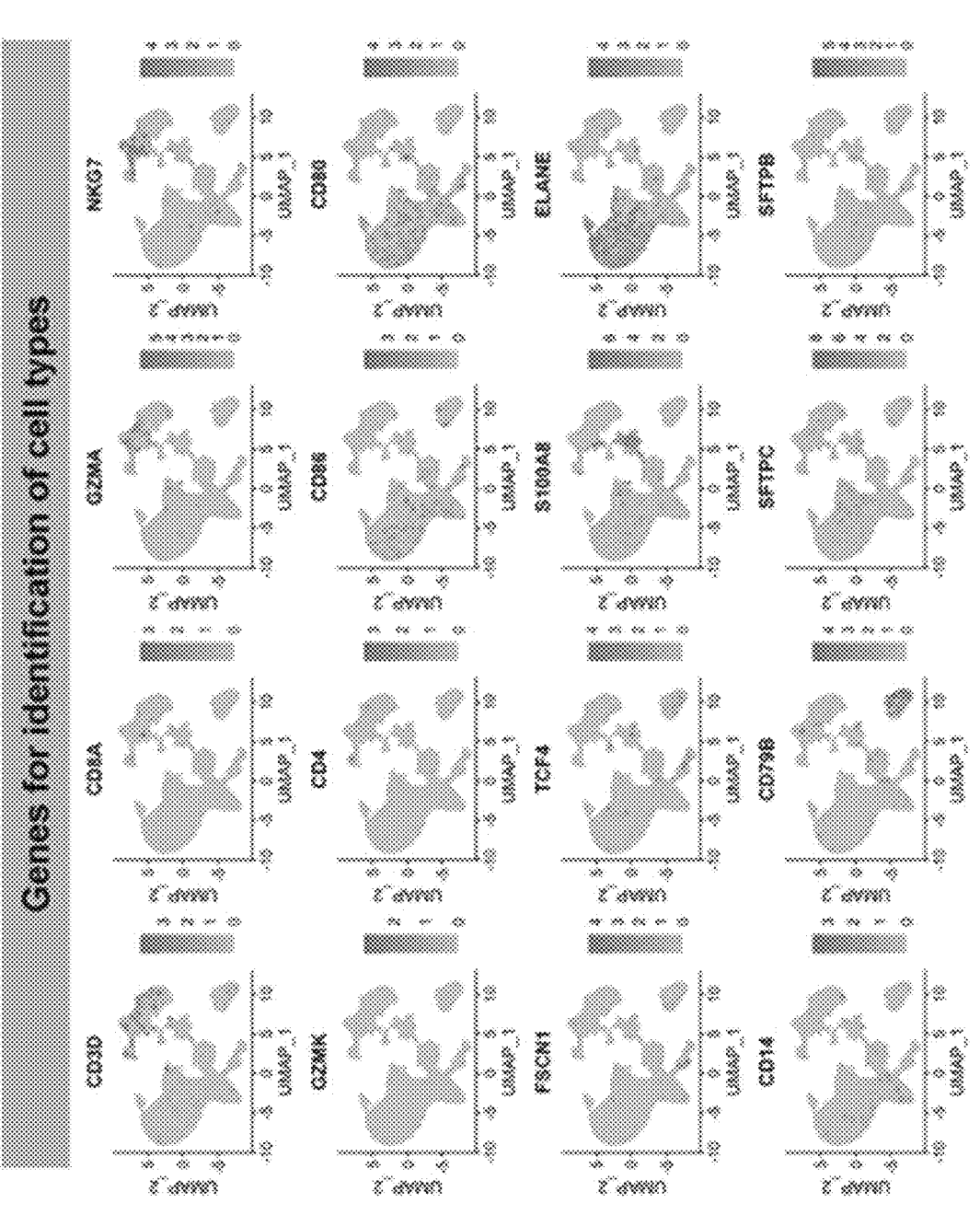
Figure 20D:
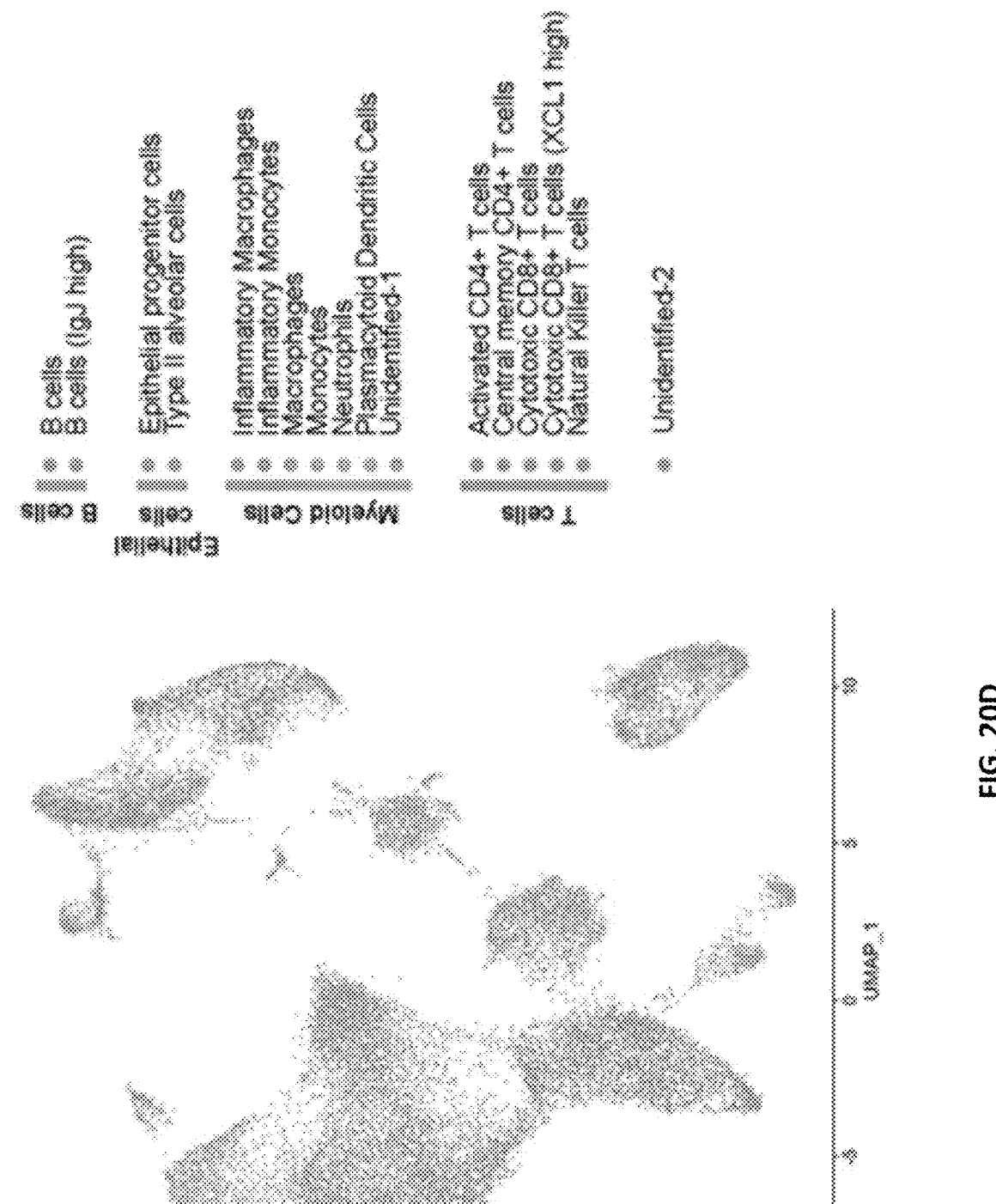
Figures 27A, 27B, 27C:
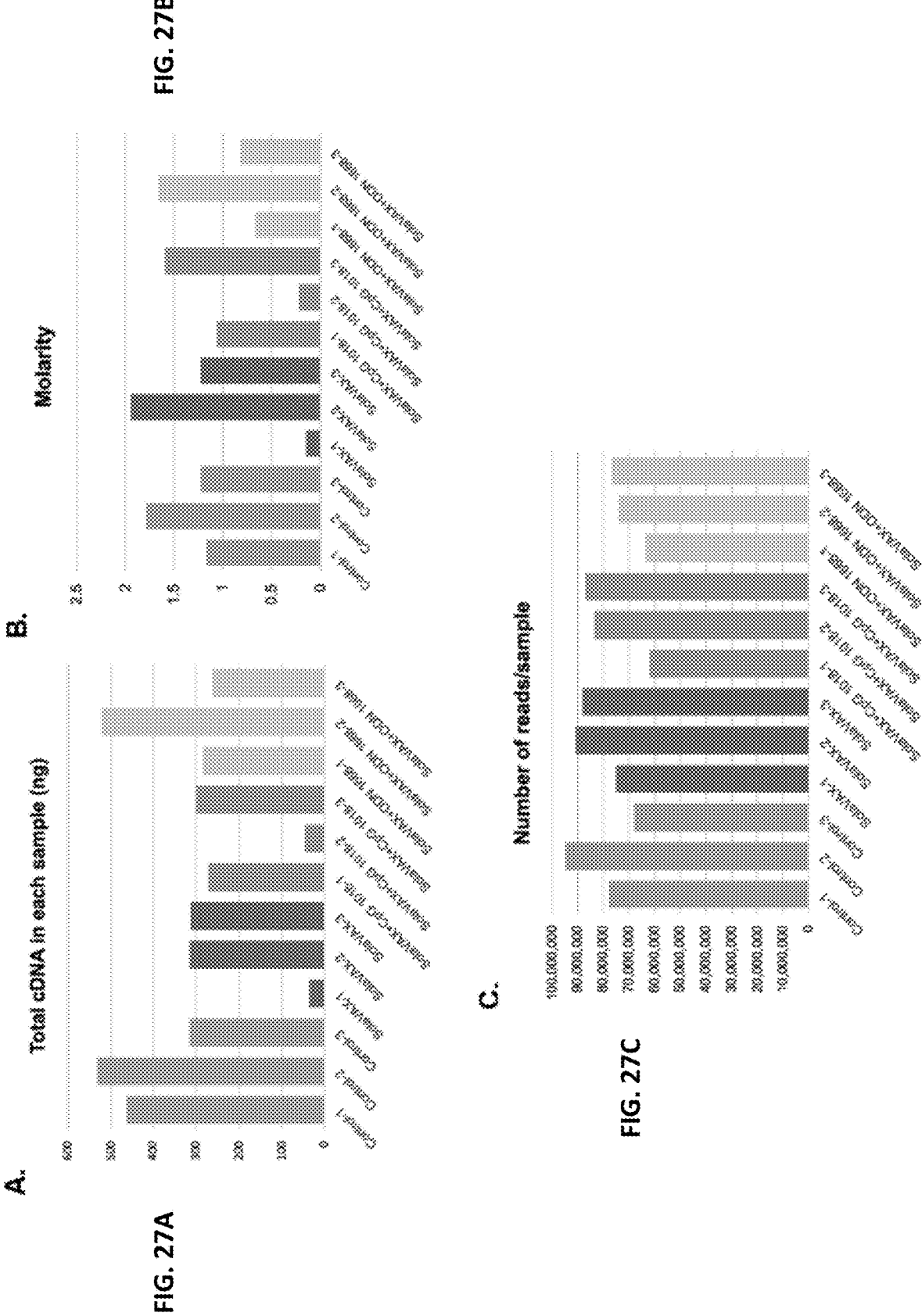
FIG. 27A-27C shows total cDNA concentration (FIG. 27A), cDNA library molarity (FIG. 27B) and number of reads (FIG. 27C) for individual samples. Total cDNA in the sample was calculated by taking concentration of cDNA obtained (in pg/μL) between 200-9000 bp. Molarity of the library was evaluated using region between 250 and 1000 bp. Number of reads were obtained from the combined sequencing run performed in Illumina® Next Seq 500®.

Transcripts were detected from an average of 750 different genes with approximately 20,000 reads/cell (FIG. 27A-27C). Using an unsupervised cluster detection algorithm (SEURAT) at low resolution, four cellular clusters were identified by the lineage-defining genes CD3D (T cells), CD86 (Myeloid cells), MARCO (Myeloid cells), SFTPC (Epithelial cells), and CD79B (B cells) (FIG. 20A-20C). All the genes used to identify cell types are presented in Table 9.

TABLE 9

Markers for identification of different cell types

| Cell Line | Marker |
|---|---|
| Inflammatory Macrophages | Marco, CD86, CD274, NLRP3, IL-1B |
| Inflammatory Monocytes | CD14, Saa3, THBS1, CCL8 |
| Macrophages | Marco, CD80, FABP5 |
| Neutrophils | ELAINE, NET1, S100A6 |
| Monocytes | S100A8, S100A9, CD14 |
| Plasmacytoid dendritic cells | TCF4, FSCN1, CD83 |
| Cytotoxic CD8 T-cells | CD3D, CD8A, GZMA, GZMB, NKG7, CD44 |
| Cytotoxic CD8 T cells, XCL[hi] | CD3D, CD8A, GZMA, NKG7, CD44, XCL |

TABLE 9-continued

| Markers for identification of different cell types | |
|---|---|
| Cell Line | Marker |
| Central memory CD4+ T cells | CD3D, CD4, CD44, CD62L, CD38 |
| Activated CD4+ T cells | CD3D, CD4, CD44, TNFRSF4 |
| NK cells | CD3D, GZMA, GZMK, TNFRSF |
| B cells IGJ$^{hi}$ | CD79B, CD74, H2-Aa, IGJ, IGHM |
| B cells | CD79B, CD74, H2-Aa |
| Type-II alveolar cells | SFTPCT, SFTPB |
| Epithelial progenitor cells | SFTPC, SOX4 |

Consistent with the histopathological analysis (See FIGS. 17A, 24A, 24B, 24C, 24D, 24E, and 24F), myeloid population was increased in non-vaccinated hamsters. Similarly, there was a higher relative abundance of T cells in lungs of CpG hamsters, in agreement with the flow cytometry results. Epithelial cells were more abundant in all SolaVAX-vaccinated groups, especially in the CpG group, consistent with increased abundance of inflammatory cells in non-vaccinated hamsters (FIG. 20A-20G). Seventeen cell subpopulations were distinguishable based on their expression profiles (Table 5). The immunological response to SARS-CoV-2 infection in non-vaccinated hamsters relied on innate cells such as inflammatory monocytes, neutrophils, plasmacytoid dendritic cells and natural killer T cells. In contrast, hamsters vaccinated with SolaVAX, particularly when formulated with CpG, had a higher frequency of lymphocytes from the adaptive immune response. Specifically, both activated CD4 T cells and cytotoxic CD8 T cells highly expressing XCL1, were increased in vaccinated hamsters. Interestingly, a specific subset of B cells that does not express IgJ are significantly increased in CpG group.

Figure 1D:
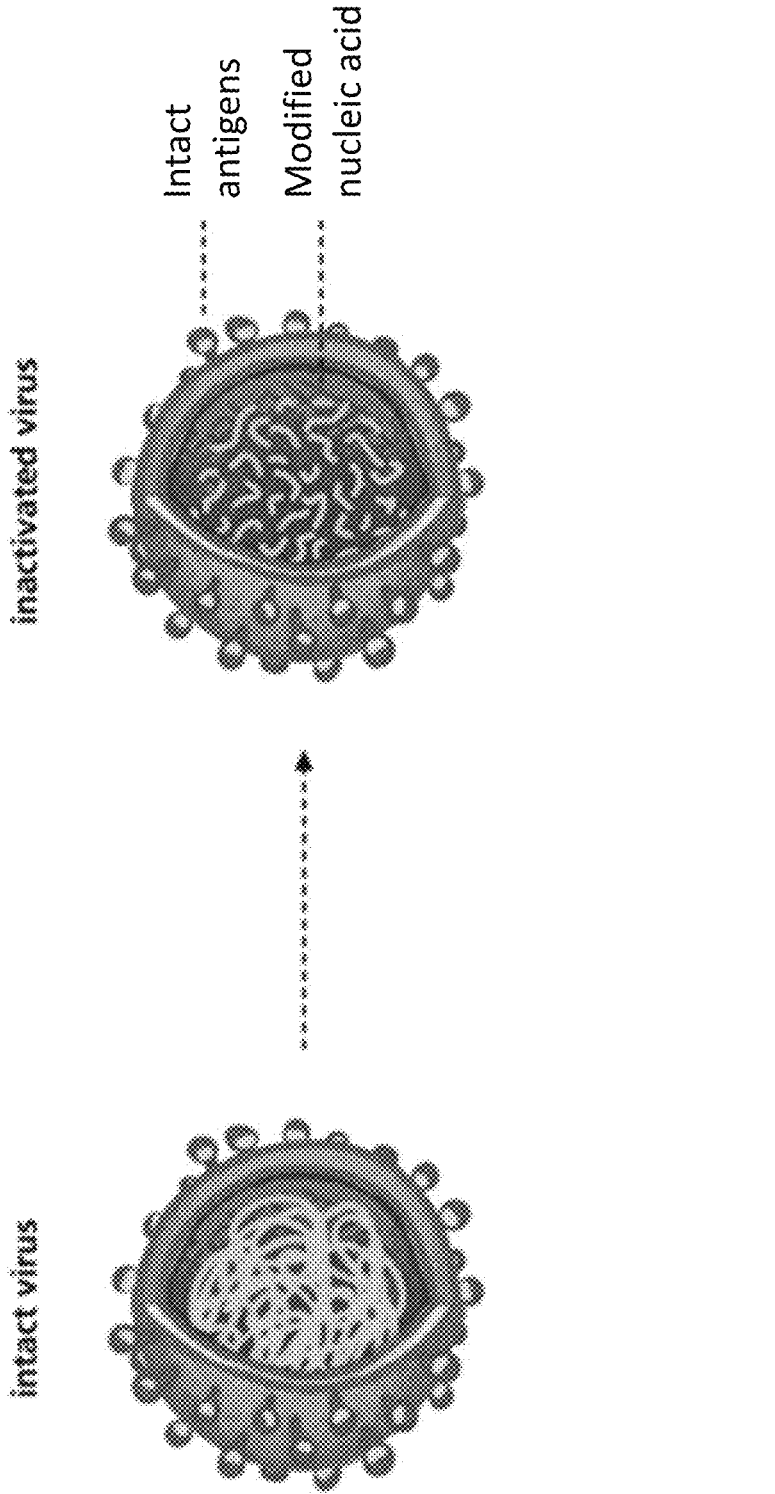
FIG. 1D is a schematic showing the difference between a viral particle before and after inactivation. After the viral particle has been inactivated, the antigens on the surface of the viral particle remain intact, but a nucleic acid within the viral particle is modified.
Figures 2A, 2B, 2C, 2D:
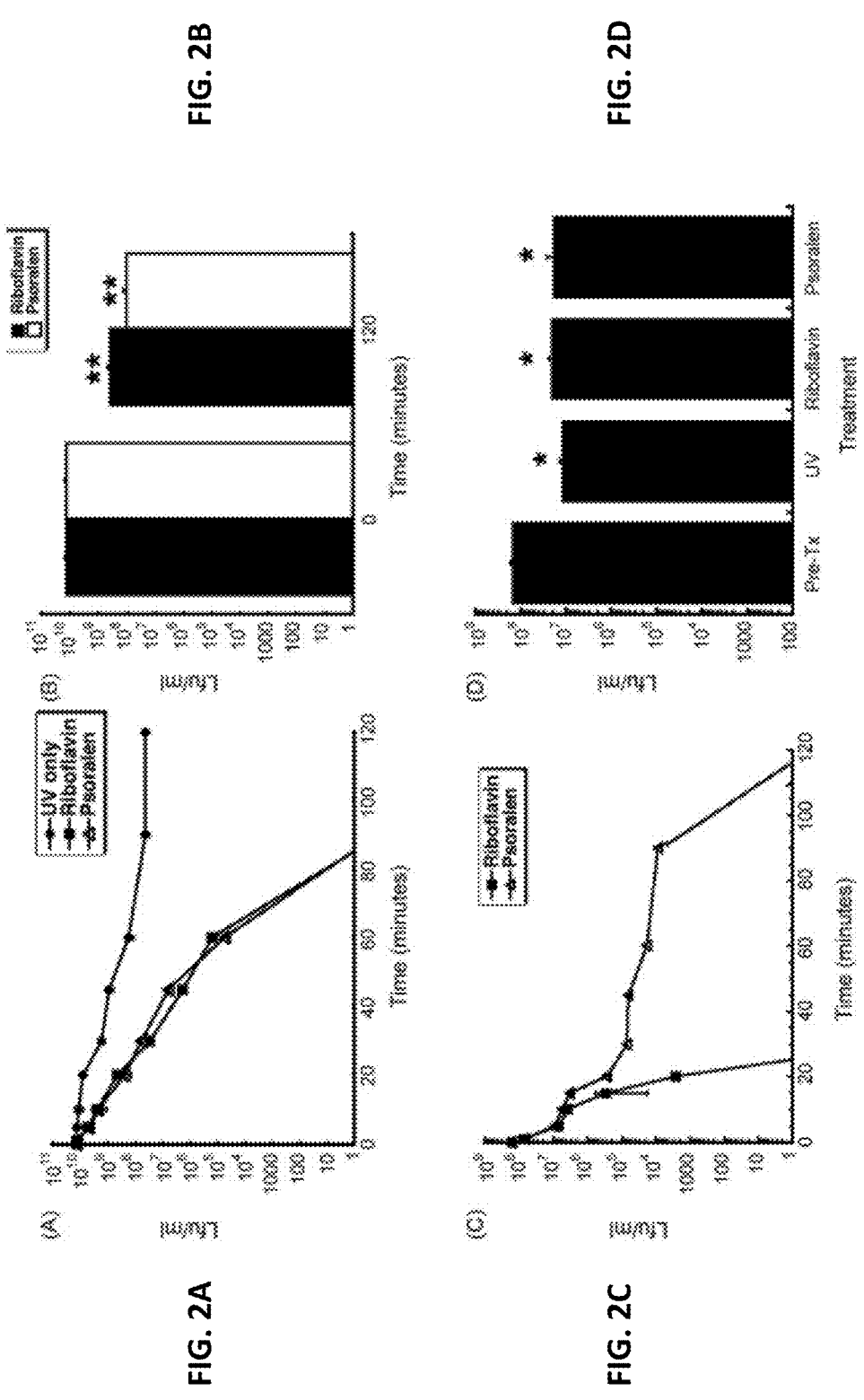
FIG. 2A-2D provides experimental data showing that riboflavin can effectively inactivate both recombinant adeno-associated viruses (AAVs) and lentiviruses.
Figures 3A, 3B, 3C, 3D:
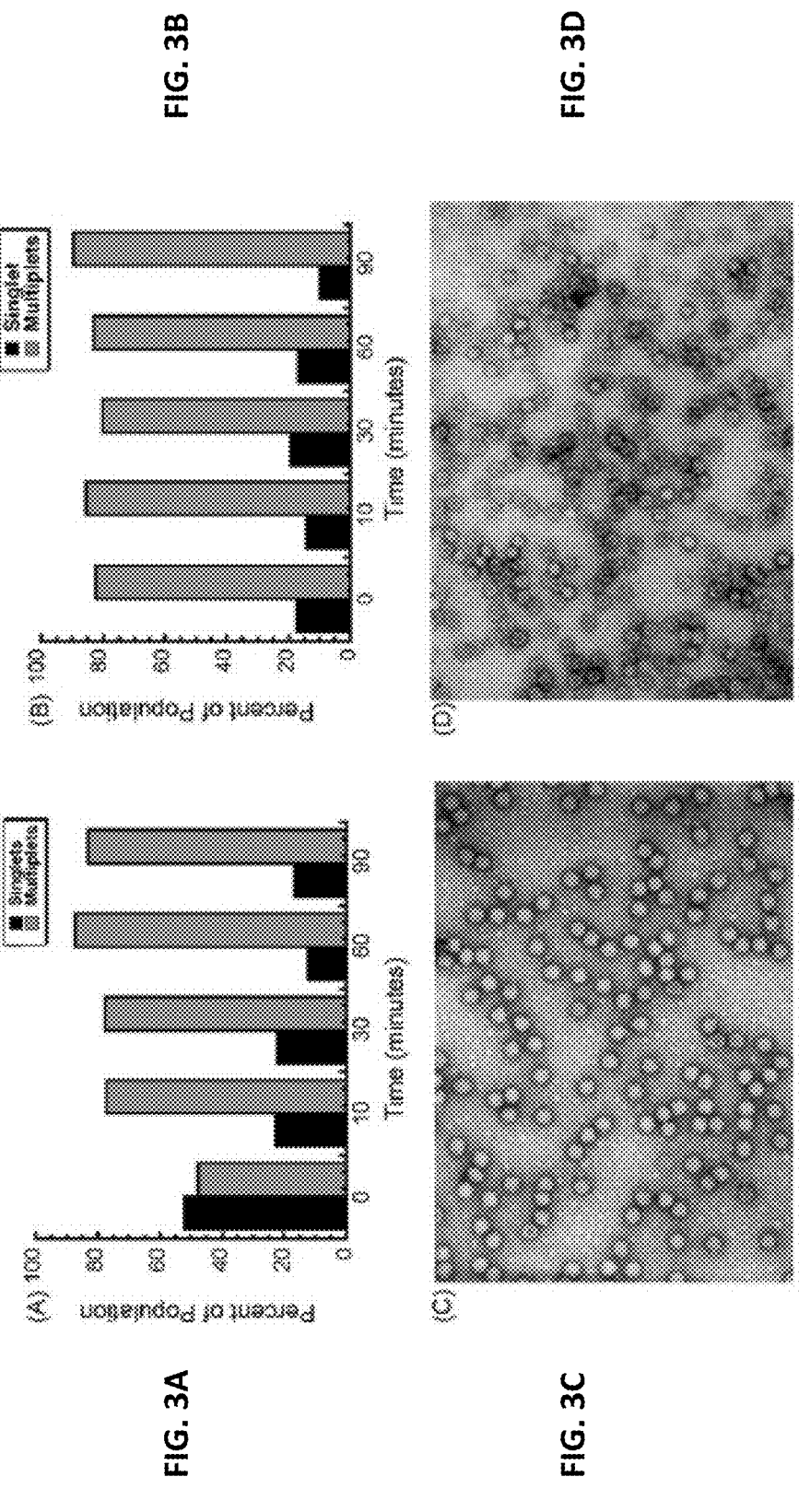
FIG. 3A-3D is experimental data showing that riboflavin can inactivate virus particles without significantly modifying proteins in the lipid capsid or inducing aggregation of the virus particles.
Figures 6A, 6B, 6C, 6D:
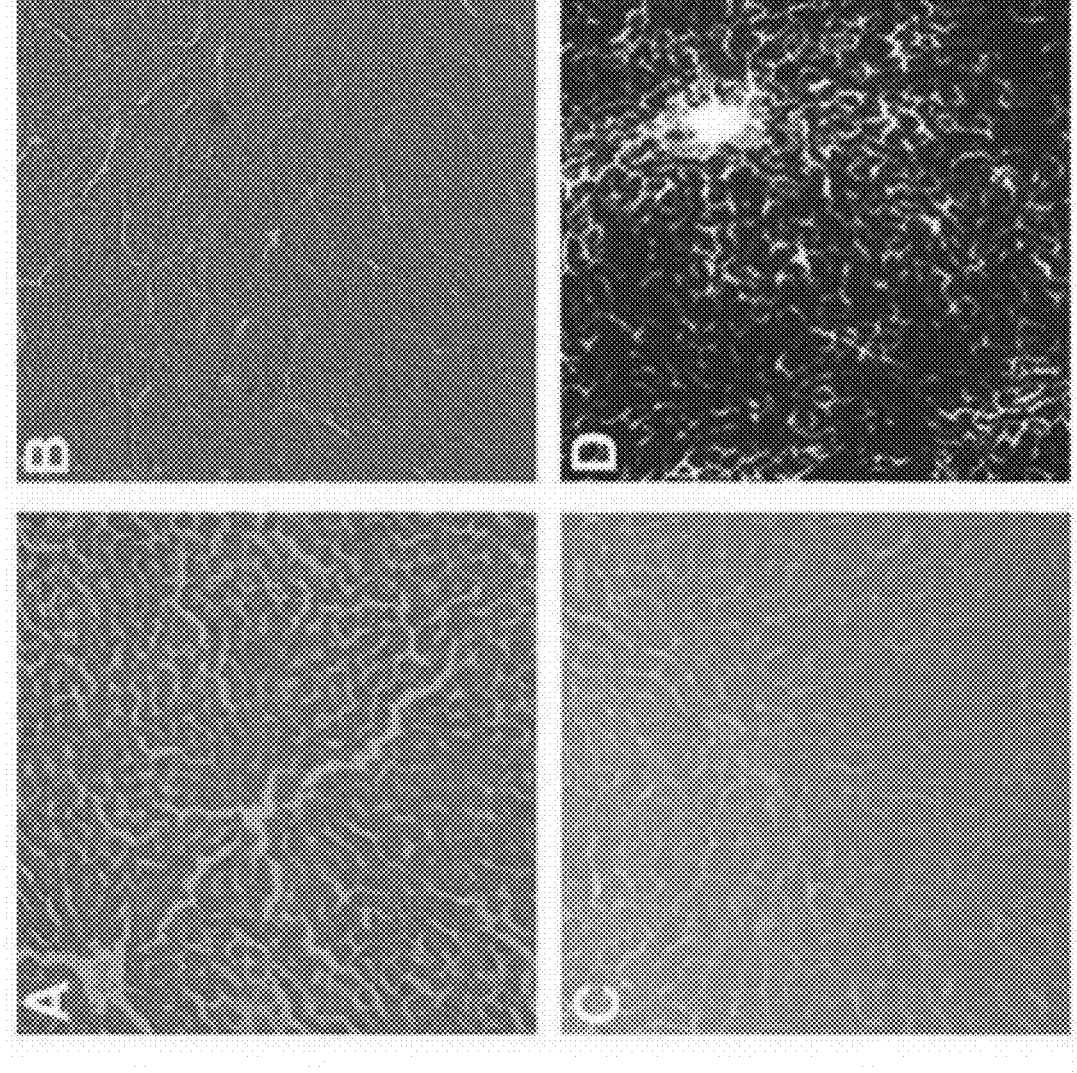
FIG. 6A-6D is experimental data showing that recombinant adenovirus inactivated by riboflavin fails to induce transgene expression in the liver after systemic administration. Hepatic sections from adult Sprague Dawley rats 4 days after treatment with (FIG. 6A) phosphate buffered saline (vehicle control) or 5.7×10$^{12}$ vp/kg of either (FIG. 6B) recombinant adenovirus expressing beta-galactosidase (Ad-lacZ) inactivated by treatment with 1.5 mM psoralen and UV light, (FIG. 6C) AdlacZ inactivated by 50 μM riboflavin and UV light or (FIG. 6D) AdlacZ prior to inactivation (positive control). Magnification in all panels: 400×.
Figure 28:
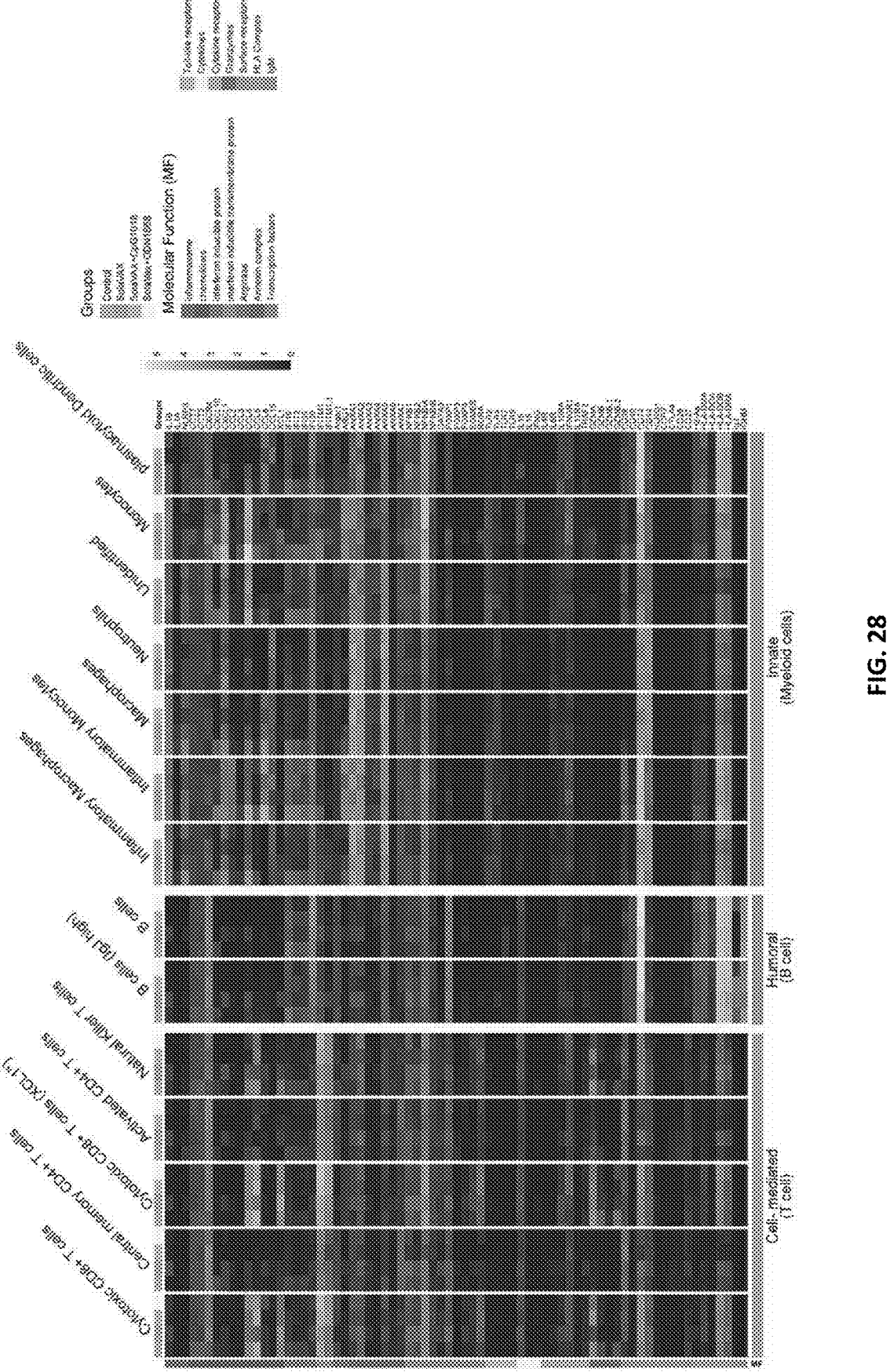
FIG. 28 shows average log fold change gene expression analysis. Average log fold change gene expression comparing pooled gene expression between Control, SolaVAX (SvX), CpG, and ODN for different molecular functions is shown across different cell types. Column annotation bar at the top represents different groups, column annotation bar at the bottom represents major immune response type and row annotation bar on the left represent different molecular functions. Cell types are annotated above each cluster in the heatmap.

The average log-fold change gene expression (avglogFC) was compared between different clusters and groups (FIG. 28, FIG. 1D). In Control hamsters, genes associated with inflammation (NLRP3, IL-310 1B, CXCL10, CCL4, CCL8, IF116), were one to two-fold higher in myeloid cells. In contrast, anti-inflammatory (ANXA1) and anti-viral (IF-ITM) genes were upregulated specifically in animals in the CpG group. Hamsters vaccinated with SolaVAX formulated in either adjuvant, also increased the expression of CD74 conducive to B cell survival and proliferation. Without an adjuvant, however, vaccination with SikaVAX drove the immune response towards Th2, as suggested by increased GATA-3 expression in both CD4+ and CD8+ T cells.

Figure 29:
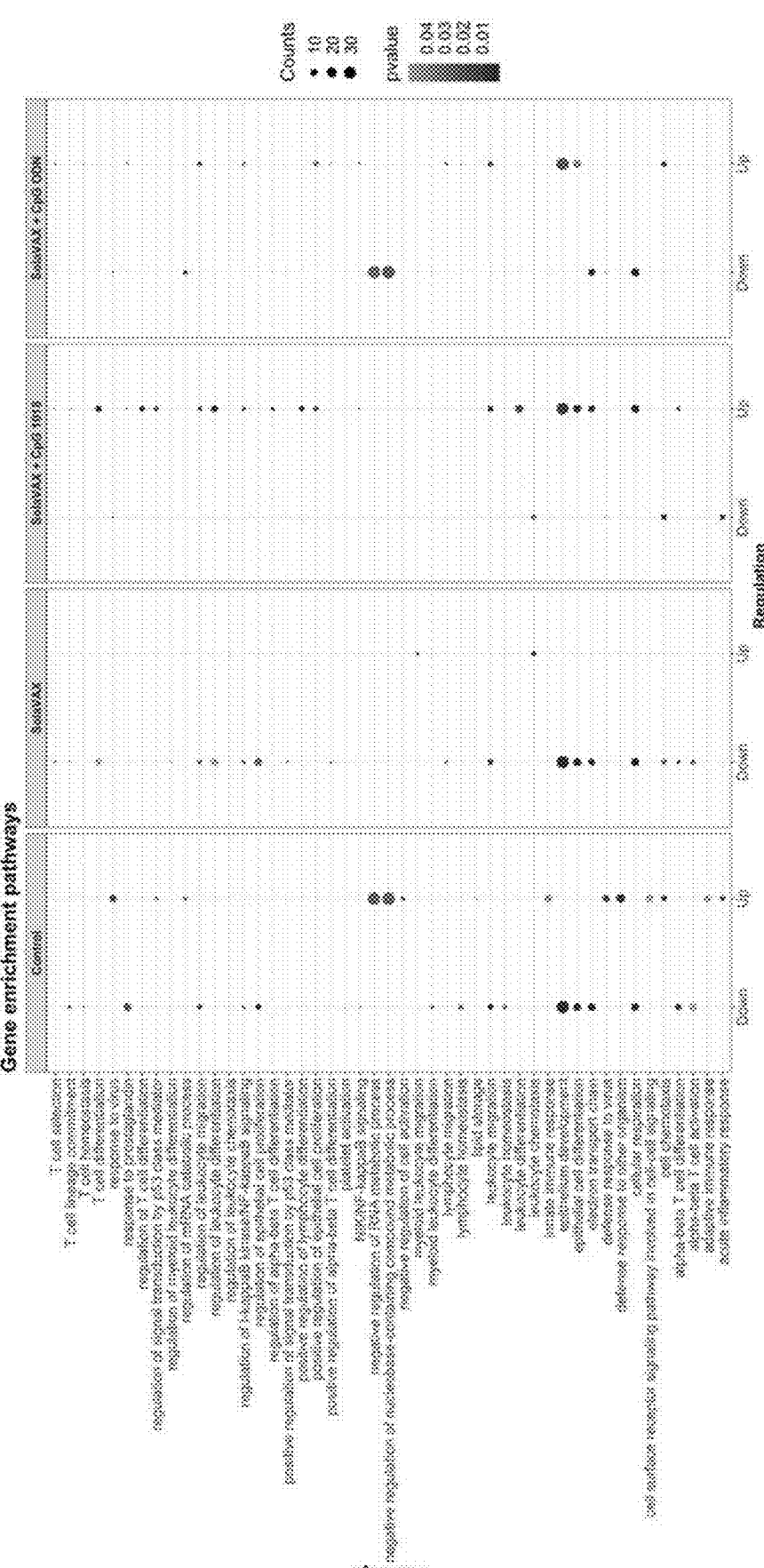
FIG. 29 shows enrichment p values for the selected Gene Ontology (GO) biological pathways of differentially expressed genes between Control and SolaVAX vaccinated hamsters, with or without adjuvant. Circles represent normalized enrichment score (NES), size of the circle represents the number of genes involved in the pathway and the color represents the significance score. $p < 0.05$ was considered significant.

Furthermore, relevant biological functions were identified using Gene Ontology (GO) enrichment analysis of differentially expressed genes (DEGs). The top GO biological pathways were evaluated for each set of DEGs and merged within groups for p-value enrichment analysis. Pathways related to T cell differentiation, leukocyte migration, and epithelial cell development were downregulated in Control and SolaVAX vaccinated groups but upregulated in CpG vaccinated group (FIG. 29). In contrast, viral and stress response pathways were upregulated in the Control group and the opposite trend was observed in all vaccinated groups. From a metabolic perspective, oxidative phosphorylation was suppressed in both Control and SolaVaAX hamsters; however, it was activated in the CpG group.

Figure 20E:
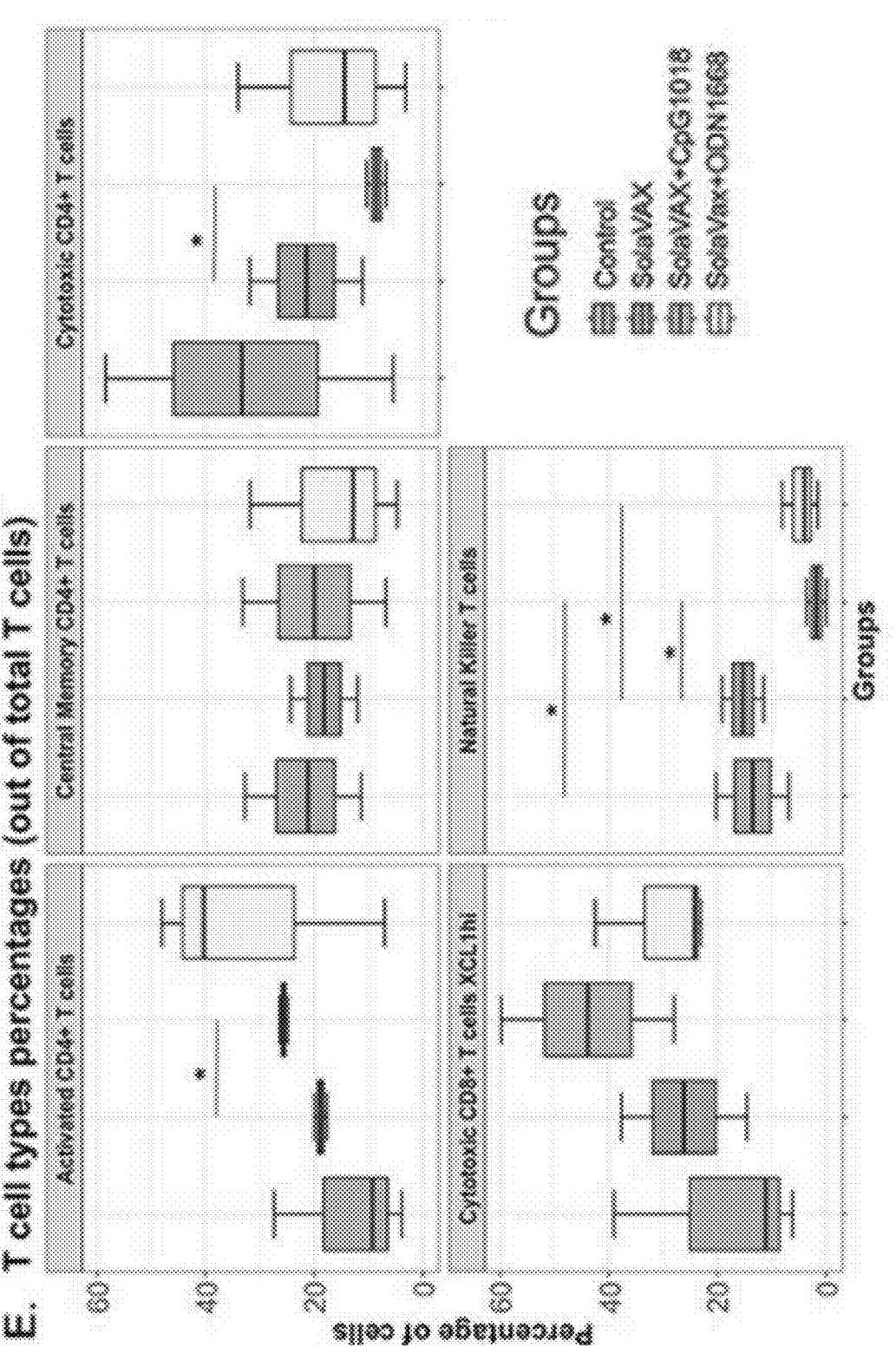
Figure 20F:
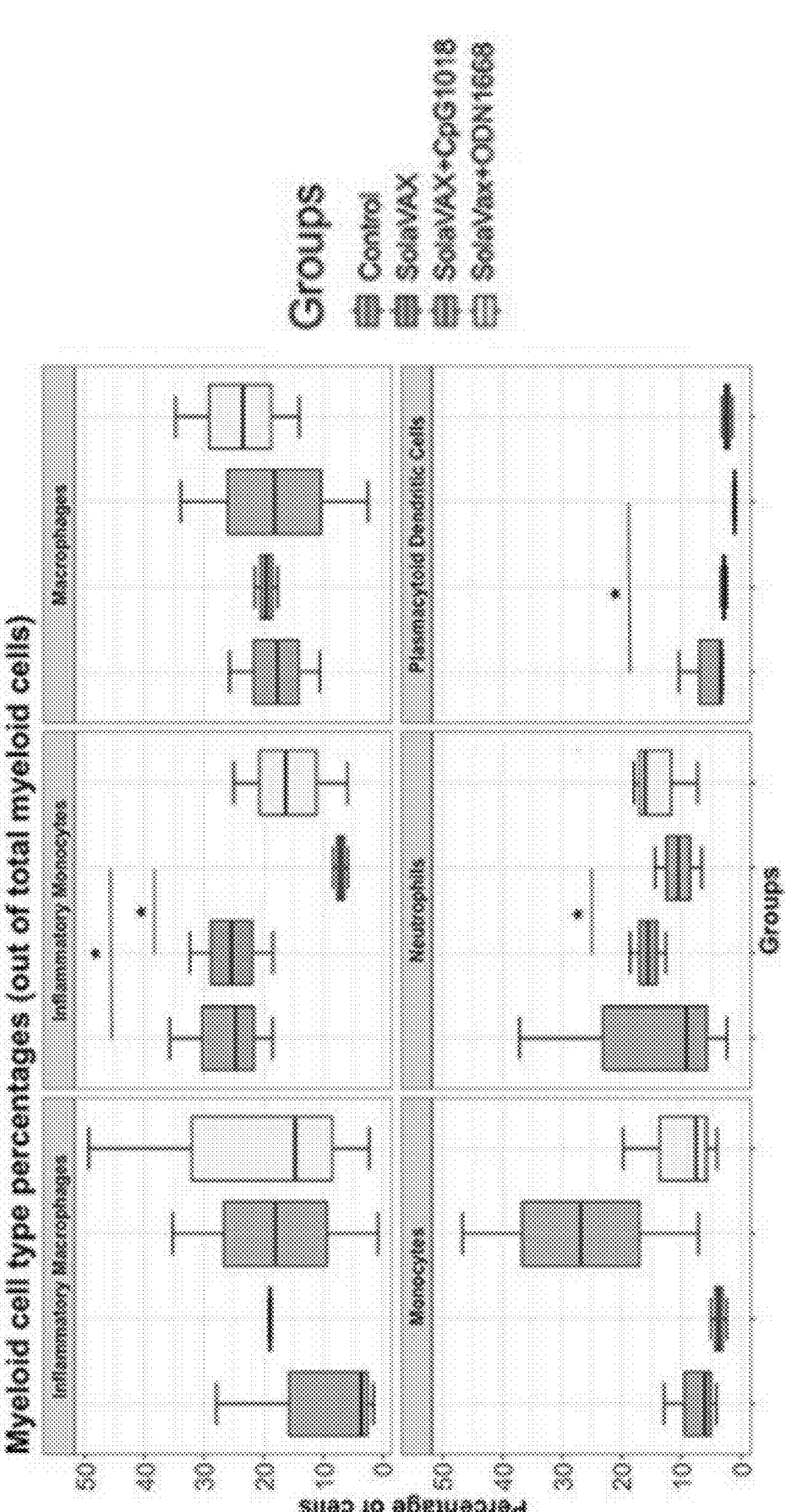
Figure 20G:
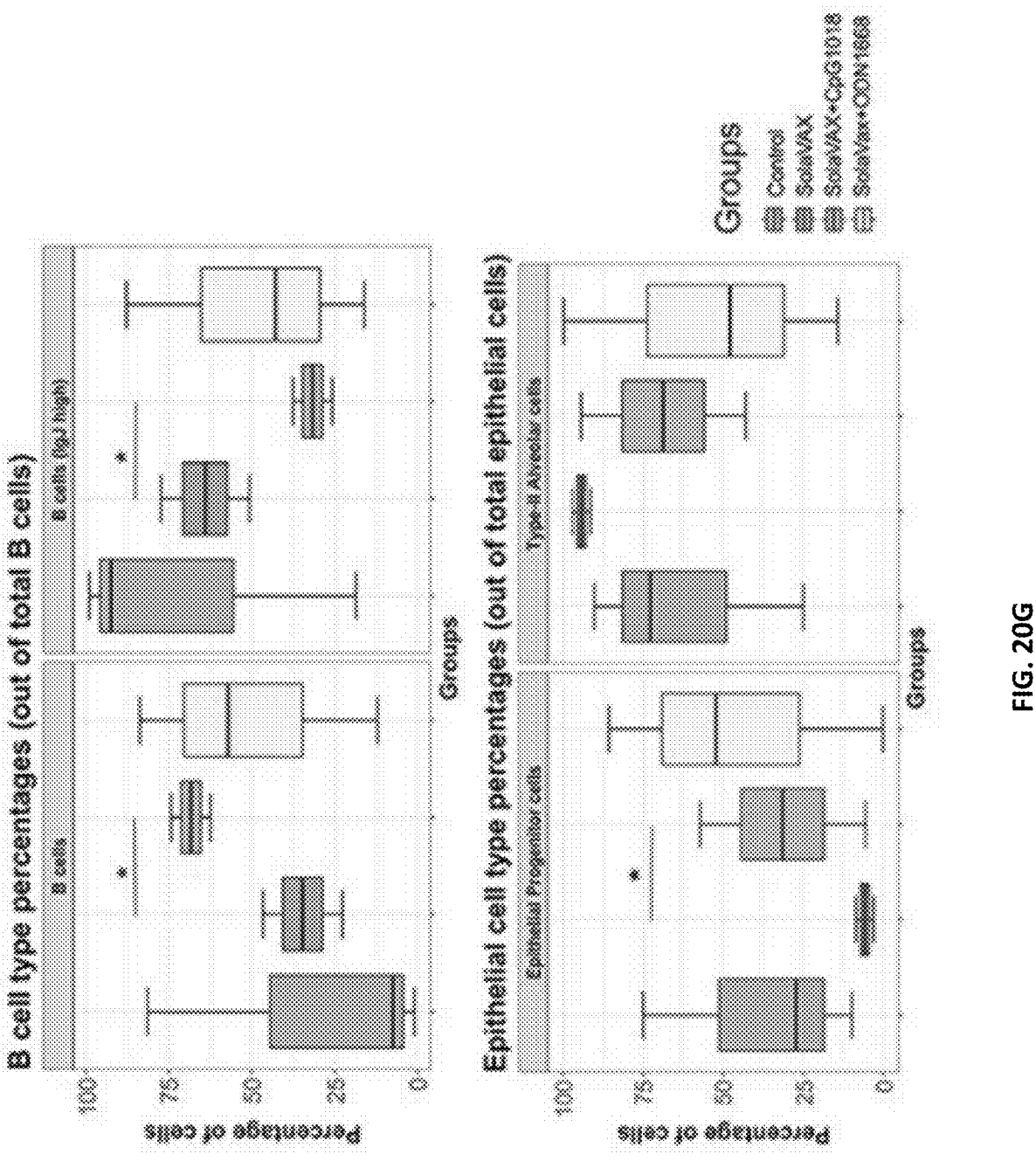
Figure 21:
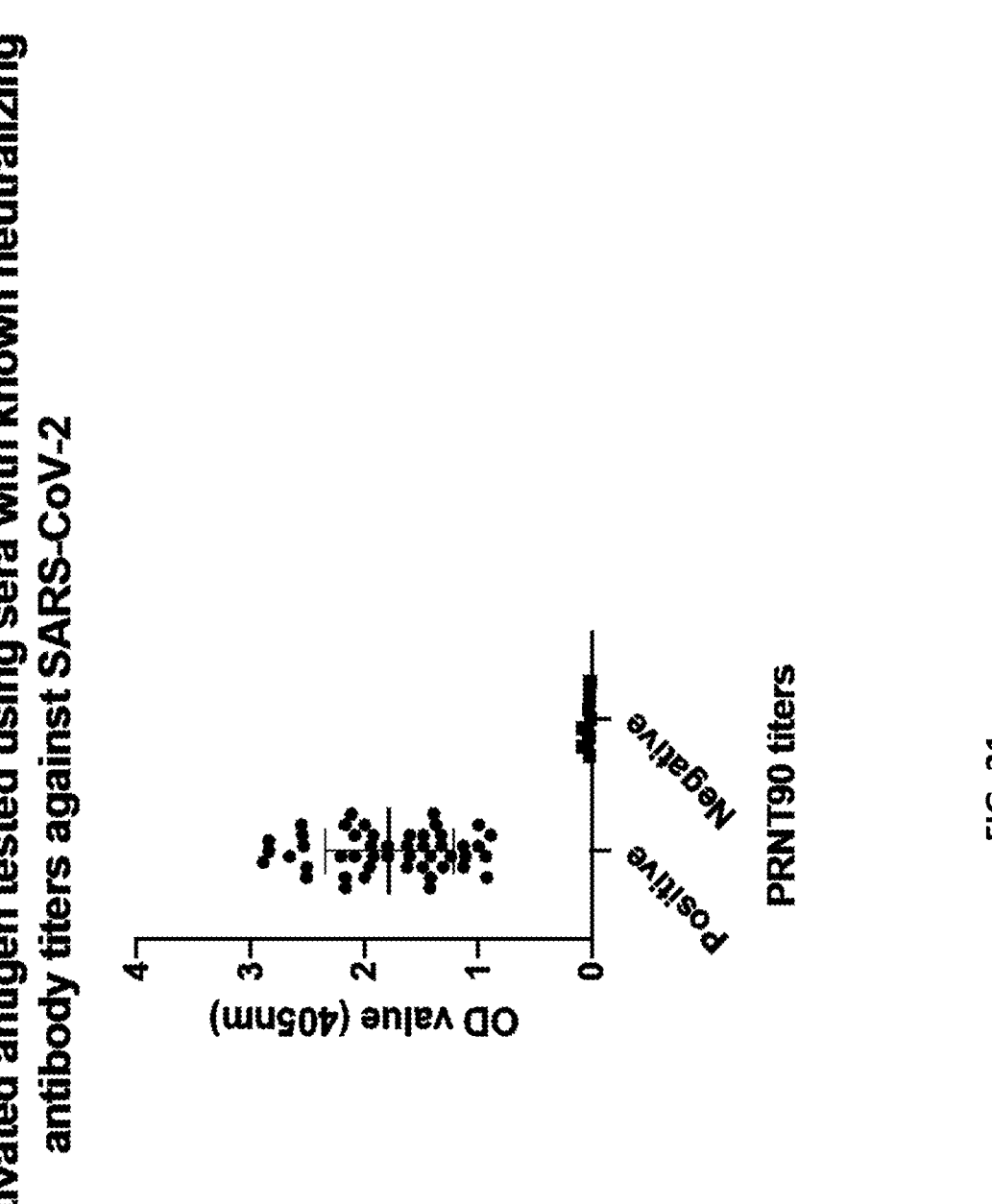
FIG. 21 is a graph showing optical density (OD) value (405 nm) of sera with known antibody titers against SARS-CoV-2. Using an indirect ELISA. Well-characterized hamster sera from SARS-CoV-2 infections were used to test accuracy of the ELISA in distinguishing negative from positive samples. Negative and positive samples were classified by plaque reduction neutralization test (PRNT90) using a 1:10 cutoff. PRNT90 titers ranged from 1:40-1:5280. Negative samples were provided from non-SARS-CoV-2 infected hamsters. ELISA results using the UV-inactivated antigen correctly identified all positive and all negative samples determined by PRNT.

Inflammatory monocytes, NKT cells, and dendritic cells were significantly reduced in the inactivated vaccine+CpG1018 adjuvant group, compared to the non-vaccinated group and the group that was vaccinated without adjuvant (FIG. 20E-20G). Expression of inflammasome-related genes, CCL4, and granzyme B were significantly reduced in the inactivated vaccine+CpG1018 adjuvant group, compared to the non-vaccinated group. Annexin-1 was upregulated in the inactivated vaccine+CpG1018 adjuvant group, compared to the non-vaccinated group. CXCL10 was highly upregulated in the non-vaccinated group compared to all other groups. IFITM complex genes were highly upregulated in the inactivated vaccine+CpG1018 adjuvant group and the inactivated vaccine+ODN-1688 group, compared to the non-vaccinated group and the group that was vaccinated without adjuvant.

Taken together, these data indicate that the inactivated SARS-CoV-2 vaccine decreases expression of inflammatory genes significantly in vivo, as compared to the non-vaccinated control. This effect was most pronounced in the inactivated vaccine+CpG1018 group, suggesting that the adjuvant may unexpectedly decrease the inflammatory response. Severe cases of COVID-19 are often associated with a hyperactive immune response. Without being bound by any theory, it is hypothesized that the inactivated SARS-CoV-2 vaccines described herein may also function, in part, by helping to prevent the hyperactive immune response often associated with SARS-CoV-2 infection.

Example 9: Development of an ELISA-Based Diagnostic Using Inactivated SARS-CoV-2 Particles An ELISA-based diagnostic was developed, to detect antibodies against SARS-CoV-2 in a biological sample using inactivated whole virion SARS-CoV-2. Briefly, UV and riboflavin was used to inactivate SARS-CoV-2. The UV-inactivated SARS-CoV-2 whole virus was coated on an ELISA plate and tested in an indirect format using hamster sera from known SARS-CoV-2 infections. ELISA #1 tested known positive and negative sera in duplicates (averaged values displayed in Table 10). Two concentrations of the antigen were tested; left half of plate had a higher concentration, and the right half had a lower concentration. Samples marked with (−) are known negative samples. Samples marked with (+) are known positive samples. Wells with italicized font are blank controls. Wells marked with an asterisk (*) are considered positive by ELISA. Wells with a hash (#) are considered negative by ELISA. The higher concentrated antigen performed better by providing a higher signal-to-noise OD reading for all positive samples.

TABLE 10

| ELISA #1 for detecting anti-SARS-COV2 antibodies | | | | | | | | | | | |
|---|---|---|---|---|---|---|---|---|---|---|---|
| Antigen coated at 6-7 ng/well | | | | | | Antigen coated at <6 ng/well | | | | | |
| 1 | 2 | 3 | 4 | 5 | 6 | 7 | 8 | 9 | 10 | 11 | 12 |
| 0.055 | 0.0285 | 0.007 | 0.001 | 0.004 | 0.0265 | 0.0105 | 0.001 | 0.0075 | 0.035 | 0.0335 | 0.08 |
| (−)# | (−)# | (−)# | (−)# | (−)# | (−)# | (−)# | (−)# | (−)# | (−)# | (−)# | (−)# |
| 0.559 | 0.596 | 0.4445 | 0.3165 | 0.61 | 0.634 | 0.0335 | 0.0265 | 0.0495 | 0.0475 | 0.072 | 0.061 * |

TABLE 10-continued

ELISA #1 for detecting anti-SARS-COV2 antibodies

| Antigen coated at 6-7 ng/well | | | | | | Antigen coated at <6 ng/well | | | | | |
|---|---|---|---|---|---|---|---|---|---|---|---|
| 1 | 2 | 3 | 4 | 5 | 6 | 7 | 8 | 9 | 10 | 11 | 12 |
| (+)* | (+)* | (+)* | (+)* | (+)* | (+)* | (+)* | (+)* | (+)* | (+)* | (+)* | (+) |
| 0.772 | 0.426 | 0.697 | 0.653 | 0.695 | 0.302 | 0.008 | 0.011 | 0.041 | 0.099 | 0.092 | 0.072 |
| (+)* | (+)* | (+)* | (+)* | (+)* | (+)* | (+)* | (+)* | (+)* | (+)* | (+)* | (+)* |
| 0.036 | 0.0185 | 0.008 | 0.006 | 0 (−)# | 0.0025 | 0.002 | 0.01 | 0.0025 | 0.006 | 0 | 0 |
| (+)* | (−)# | (−)# | (−)# | | | | (−)# | (−)# | (−)# | | |

Results show that not only did the antigen produced by UV inactivation allow for the binding and detection of antibodies against SARS-CoV-2 in sera, the more concentrated antigen produced a strong signal-to-noise ratio where positive samples produced a high signal and the negative samples produced little to no signal with minimal background interference.

To confirm the results, a second ELISA was performed (Table 11, FIG. 22) using sera previously tested by a plaque reduction neutralization test (PRNT). All samples were again tested in duplicated (averaged values displayed in Table 11). Results confirmed the successful use of the antigen in detecting antibodies as well as the use of the antigen in an ELISA correlates strongly with PRNT results.

However, no significant indels in the furin cleavage site were noted. A list of SNVs identified in the viral stock is provided in Table 12 and indel structural variants is provided in Table 13. The corresponding amino acid change caused by the SNV is also listed. The percentages listed in the tables represent the amount of viral genome in the sample that was associated with that particular variant in the viral stock, and represent average values from 3-4 samples. Tables 12 and 13 list only those variants present at 4% or more. "S" refers to the spike protein and "N" refers to nucleocapsid protein. The analysis shown in Tables 12 and 13 demonstrate how SARS-CoV-2 variants may be identified and quantified in viral preparations. The sequence listed in Table 13 (SEQ ID

TABLE 11

ELISA #2 for detecting anti-SARS-COV2 antibodies

| Antigen coated at 6-7 ng/well | | | | | | Antigen coated at <6 ng/well | | | | | |
|---|---|---|---|---|---|---|---|---|---|---|---|
| 1 | 2 | 3 | 4 | 5 | 6 | 7 | 8 | 9 | 10 | 11 | 12 |
| 0.8875 | 0.9355 | 0.926 | 1.3075 | 1.2405 | 1.4235 | 1.6015 | 2.5055 | 2.536 | 2.546 | 2.167 | 1.6015 |
| (+)* | (+)* | (+)* | (+)* | (+)* | (+)* | (+)* | (+)* | (+)* | (+)* | (+)* | (+)* |
| 1.3725 | 1.49 | 1.1105 | 1.3925 | 2.1155 | 1.9415 | 2.5085 | 1.955 | 2.555 | 2.6585 | 2.8885 | 2.206 |
| (+)* | (+)* | (+)* | (+)* | (+)* | (+)* | (+)* | (+)* | (+)* | (+)* | (+)* | (+)* |
| 1.1285 | 0.9995 | 1.325 | 1.418 | 1.4815 | 1.7945 | 1.6255 | 2.169 | 2.0835 | 1.921 | 2.842 | 1.997 |
| (+)* | (+)* | (+)* | (+)* | (+): | (+)* | (+)* | (+)* | (+)* | (+)* | (+)* | (+)* |
| 1.101 | 0.0795 | 0.02 | 0.785 | 0.013 | 0.014 | 0.024 | 0.032 | 0.022 | 0.0205 | 0.0005 | −0.001 |
| (+)* | (−)# | (−)# | (−)# | (−)# | (−)# | (−)# | (−)# | (−)# | (−)# | | |

In both ELISA tests, samples that were known positive were also positive by ELISA. Sample known negative were also negative by ELISA. Taken together, this data indicates that the UV-inactivation method for producing whole viral antigen is suitable for ELISA application.

Example 10: Inactivated SARS-CoV-2 Viral Vaccine is Effective Against SARS-CoV-2 Variants The purpose of this study was to confirm whether the inactivated SARS-CoV-2 viral vaccine is effective against SARS-CoV-2 variants. Next-generation sequencing (NGS) was used to detect SARS-CoV-2 variants in various viral preparations used in the experiments described above (See, e.g., Example 5).

First, NGS was used to identify variants in a viral stock sequence, which was isolated from a SARS-CoV-2 patient, plaque purified, and subsequently propagated in culture. This analysis identified a high frequency of single nucleotide variants (SNVs) in all flasks in concentrated and clarified filtrate (CCF) and ultrafiltration/defiltration (UF/DF) pools, including furin cleavage site SNVs. Other variants comprising one or more indels (insertions or deletions) were also identified. For example, one ORF8 deletion was detected.

NO: 23) represents a sequence from ORF8 that was deleted in one identified variant, which is also referred to as the "UK variant."

TABLE 12

| Single Nucleotide Variants in SARS-COV-2 Viral Stock | | | | |
|---|---|---|---|---|
| Nucleotide position (relative to SEQ ID NO: 23) | Gene | Effect | Variant | Average (3-4 replicates) |
| 7388 | nsp3 (non-structural protein 3) | Missense | A1557T | 9.7% |
| 11117 | nsp6 (non-structural protein 6) | Missense | nsp6 I49V | 66.8% |
| 15058 | nsp12 (non-structural protein 12) | Stop Lost | nsp12 T540P | 4.4% |
| 15089 | nsp12 (non-structural protein) | Missense | Q550K | 5.5% |
| 221 | 5' UTR | Non-coding change | | 25.3% |
| 23607 | S | Missense | SR682Q | 6.0% |

TABLE 12-continued

| Single Nucleotide Variants in SARS-COV-2 Viral Stock | | | | |
|---|---|---|---|---|
| Nucleotide position (relative to SEQ ID NO: 23) | Gene | Effect | Variant | Average (3-4 replicates) |
| 23616 | S | Missense | SR685H | 21.7% |
| 29017 | N | Synonymous | NK248K | 27.3% |

TABLE 13

| | | InDel Structural Variants in SARS-COV-2 Viral Stocks | | | | |
|---|---|---|---|---|---|---|
| Reference Sequence | Position (relative to SEQ ID NO: 23) | Reference base(s) | Variant base(s) | Notes | Average (3-4 replicates) | |
| MN985325 | 27877 | GTCACGCCTAAACGAACATGAAATT (SEQ ID NO: 24) | G | Deletion removing ORF8 start codon | 25.6% | |

Thus, the analysis shown in Tables 12 and 13 demonstrate how SARS-CoV-2 variants may be identified and quantified in viral preparations.

Next, viral stocks were examined after several rounds of passaging (Stock V2). To examine the effect of inactivation on the SARS-CoV-2 variants, NGS was performed on the viral stock 18 days later, immediately before treatment with riboflavin and UV light (pre-mirasol) and after treatment (post-mirasol). Results are shown in Table 14. Passage generally led to an increase in variants compared to the stock (compare Stock V2 vs. Pre-Mirasol). Notably, no significant change was observed in variants after inactivation using riboflavin and UV light (compare pre-mirasol vs. post-mirasol), which indicates that the inactivation did not cause a significant number of mutations in the viral genomes.

TABLE 14

| | | | | SARS-COV-2 Variants in Viral Stocks After Passaging, and Before and After Inactivation Using Riboflavin and UV Light | | |
|---|---|---|---|---|---|---|
| Position (relative to SEQ ID NO: 23) | Gene | Variant | Effect | Stock V2 (Day 0) | (Day 18) Pre-Mirasol | Post-Mirasol (18 days later) |
| 2071 | nsp2 | T422T | synonymous_variant | 0% | 5% | 4% |
| 4668 | nsp3 | S650F | missense_variant | 20% | 0% | 0% |
| 5457 | nsp3 | T913I | missense_variant | 6% | 0% | 0% |
| 13845 | nsp12 | M135R | missense_variant | 30% | 94% | 93% |
| 19338 | nsp14 | K433K | synonymous_variant | 3% | 8% | 8% |
| 21849 | S | E96A | missense_variant | 14% | 0% | 0% |
| 22205 | S | D215H | missense_variant | 61% | 96% | 96% |
| 23616 | S | R685H | missense_variant | 28% | 94% | 94% |
| 26542 | M | T7I | missense_variant | 71% | 97% | 97% |
| 28853 | N | S194T | missense_variant | 72% | 97% | 97% |

NGS analysis was next performed on the viral stock used in the first challenge study, described above in Examples 4-5. In this study, the initial vaccine and boost compositions were made from the same viral stock. Notably, as shown in Table 15, the compositions used for the initial vaccination and boost were mixtures comprising numerous SARS-CoV-2 variants.

Results from this analysis are shown in Table 15. Notably, several spike protein region mutations were detected, including a variant comprising a D215H mutation. The D215 locus is also mutated in a prominent SARS-CoV-2 variant with South African lineage, but D215 is mutated to a different amino acid in that variant. A R685H mutation was also detected, which represents a mutation in the furin cleavage site.

Notably, a similar composition of variants was observed in vaccine, boost, and challenge (inoculation) materials used in the first challenge study. As shown above in Examples 4 and 5, use of these viral stocks for vaccination and challenge produced high antibody titers in test animals.

TABLE 15

SARS-COV-2 Variants Identified in Viral
Stocks Used for First Challenge Study

| Position | Gene | Variant | Effect | Vaccine and Boost 1 | Challenge 1 |
|---|---|---|---|---|---|
| 22205 | S | D215H | missense_variant | 96% | 96% |
| 23616 | S | R685H | missense_variant | 94% | 94% |
| 26542 | M | T71 | missense_variant | 97% | 97% |
| 28853 | N | S194T | missense_variant | 97% | 97% |

Additionally, NGS analysis was performed for viral stocks used in the second challenge study (See Example 5). Results are shown in Table 16 and 17. Similarly, several spike protein region mutations were detected, including a variant comprising a D215H mutation. The R685H mutation was again detected, and the N679_R685del mutation removes the furin cleavage site.

TABLE 16

SARS-COV-2 Variants in Initial Vaccine and Boost
Compositions Used for Second Challenge Study

| Position | Gene | Variant | Effect | Vaccine | Boost |
|---|---|---|---|---|---|
| 22205 | S | D215H | missense_variant | 97% | 97% |
| 23595 | S | N679_R685del | disruptive_inframe_deletion | 5% | 14% |
| 23616 | S | R685H | missense | 95% | 96% |
| 26542 | M | T7I | missense | 96% | 97% |
| 26713 | M | CFV64WY | 3 to 2AA replacement | 16% | 34% |
| 28853 | N | S194T | missense | 98% | 99% |
| 29051 | N | R262fs | frameshift | 0% | 9% |

TABLE 17

SARS-COV-2 Variants in Challenge Material Used for
Inoculation in Second Challenge Study

| Position | Gene | Variant | Effect | Challenge |
|---|---|---|---|---|
| 21849 | S | E96A | missense_variant | 6% |
| 21857 | S | N99delinsKLNY | disruptive_inframe_insertion | 31% |
| 22205 | S | D215H | missense_variant | 19% |
| 22206 | S | D215_L216insKLRS | conservative_inframe_insertion | 6% |
| 23525 | S | H655Y | missense_variant | 5% |
| 23616 | S | R685H | missense_variant | 9% |
| 26542 | M | T7I | missense_variant | 55% |
| 28853 | N | S194T | missense_variant | 57% |

Notably, as shown in Tables 16 and 17, test animals were vaccinated and challenged with viral socks with different variant compositions, i.e., there were more variants and different percentages thereof in the challenge (inoculation) material than observed in the vaccine prime and boost materials used in this study. For example, lower levels of D215H and R685H mutants were detected in the challenge material, compared to prime and boost. No N679_R685del was observed in the challenge material. H655Y, N99delinsKLNY and D215_L216insKLRS were present in the challenge material, and were not seen in the prime or boost material. Despite the differences in composition between vaccination and variant stocks the inactivated SARS-CoV-2 vaccine was still effective in the test animals (See Example 5), even when challenge occurred 92 days after the initial vaccination.

Taken together, this data indicates that inactivation does not appear to alter the composition of the virus variant mixture. Challenge study 1 had good homology among vaccine prime, boost and challenge material (S, M, N genes). Challenge study 2 showed good homology between vaccine prime and boost but some significant differences with challenge material (S, M, N genes). For example, the R685H mutation in the furin cleavage site which was present at high levels in the prime and boost (95-96%) but only at 9% in the challenge material. The D215H variant is a mutation in the spike 215 and is also mutated in South African lineage (to a different amino acid). It is present at high levels in the prime and boost (97%) but only at 19% in the challenge material. Additional spike variants were present in the Challenge study 2 material that were not present in the prime or boost used in that study. Nevertheless, results showed protection by the vaccine. Notably, the Orf8 deletion seen in HCM was not observed in any of the vaccine or challenge materials evaluated.

NUMBERED EMBODIMENTS

Notwithstanding the appended claims, the following numbered embodiments are also contemplated herein.

Embodiment Set A—Inactivation of Viral Particles

1A. A method for inactivating a viral particle, the method comprising contacting the viral particle with a dose of UV light in the presence of riboflavin.

2A. The method of embodiment 1A, wherein the viral particle is a SARS-CoV-2 particle.

3A. The method of embodiment 1A, wherein the viral particle is an African Swine Fever virus particle.

4A. The method of embodiment 1A, wherein the viral particle is an adenovirus particle, an adeno-associated virus (AAV) particle, a lentivirus particle, a coronavirus particle, or a retrovirus particle.

5A. The method of embodiment 1A, wherein the viral particle is a Dengue, Zika, Influenza, Marburg, Rabies, Human Immunodeficiency Virus (HIV), Smallpox, Hantavirus, Rotavirus, SARS-CoV, MERS-CoV, Cytomegalovirus (CMV), Ebola, Epstein-Barr, Herpes, Hepatitis, Human Papillomavirus, Mumps, Measles, Rubella, Polio, Varicella Zoster, Respiratory Syncytial Virus (RSV), Semliki Forest, West Nile, Yellow Fever, or Vesicular Stomatitis particle.

6A. The method of any one of embodiments 1A-5A, wherein the dose of UV light is about 100 Joules to about 1000 Joules.

7A. The method of any one of embodiments 1A-6A, wherein the dose of UV light is about 100 Joules.

8A. The method of any one of embodiments 1A-4A, wherein the method comprises altering a nucleic acid of the viral particle.

9A. The method of embodiment 8A, wherein the method comprises selectively oxidizing guanine bases in the nucleic acid.

10A. The method of embodiment 9A, wherein the UV light selectively oxidizes about 1 to about 30 guanine bases in the nucleic acid of the viral particle.

11A. The method of embodiment 10A, wherein the UV light selectively oxidizes about 20 guanine bases in the nucleic acid of the viral particle.

12A. The method of any one of embodiments 8A-11A, wherein the nucleic acid of the viral particle is a DNA or an RNA.

13A. The method of any one of embodiments 1A-12A, wherein the method does not comprise substantially altering the structure of antigens on the viral particle.

14A. The method of any one of embodiments 1A-13A, wherein the inactivated viral particle is not capable of replicating in a cell.

15A. The method of any one of embodiments 1A-14A, wherein the inactivated viral particle is not capable of causing disease in a subject.

16A. A vaccine composition comprising a viral particle inactivated according to any one of embodiments 1A-15A.

17A. The vaccine composition of embodiment 16A, wherein the composition comprises about 1 to about 100 picograms of viral protein.

18A. The vaccine composition of embodiment 17A, wherein the composition comprises about 15 to about 50 picograms of viral protein.

19A. The vaccine composition of embodiment 18A, wherein the composition comprises about 35 picograms of viral protein.

20A. The vaccine composition of any one of embodiments 16A-19A, wherein the composition comprises an adjuvant.

21A. The vaccine composition of embodiment 20A, wherein the adjuvant is capable of promoting a Th1-type immune response.

22A. The vaccine composition of embodiment 20A or 21A, wherein the adjuvant is capable of limiting a Th2-type response.

23A. The vaccine composition of any one of embodiments 20A-22A, wherein the adjuvant is CpG and/or AS01.

24A. The vaccine composition of any one of embodiments 20A-22A, wherein the adjuvant is a phosphorothioate oligonucleotide comprising about 15 to about 30 nucleotides.

25A. The vaccine composition of any one of embodiments 20A-22A, wherein the adjuvant comprises the sequence 5'-TGACTGTGAACGTTCGAGATGA-3' (SEQ ID NO: 21).

26A. The vaccine composition of any one of embodiments 20A-22A, wherein the adjuvant comprises the sequence 5'-TCCATGACGTTCCTGATGCT-3' (SEQ ID NO: 22).

27A. The vaccine composition of any one of embodiments 20A-22A, wherein the adjuvant is ODN 1668.

28A. The vaccine composition of any one of embodiments 20A-22A, wherein the adjuvant is CpG 1018.

29A. The vaccine composition of any one of embodiments 16A-28A, wherein the composition comprises a pharmaceutically acceptable carrier or excipient.

30A. A vaccine composition comprising an inactivated SARS-CoV-2 viral particle, wherein the SARS-CoV-2 genome comprises one or more oxidized guanine residues.

31A. The vaccine composition of embodiment 30A, wherein the composition comprises about 1 to about 100 picograms of viral protein.

32A. The vaccine composition of embodiment 31A, wherein the composition comprises about 15 to about 50 picograms of viral protein.

33A. The vaccine composition of embodiment 32A, wherein the composition comprises about 35 picograms of viral protein.

34A. The vaccine composition of any one of embodiments 30A-33A, wherein the composition comprises an adjuvant.

35A. The vaccine composition of embodiment 34A, wherein the adjuvant is capable of promoting a Th1-type immune response.

36A. The vaccine composition of embodiment 34A or 35A, wherein the adjuvant is capable of limiting a Th2-type response.

37A. The vaccine composition of any one of embodiments 34A-36A, wherein the adjuvant is CpG and/or AS01.

38A. The vaccine composition of any one of embodiments 34A-36A, wherein the adjuvant is a phosphorothioate oligonucleotide comprising about 15 to about 30 nucleotides.

39A. The vaccine composition of any one of embodiments 34A-36A, wherein the adjuvant comprises the sequence 5'-TGACTGTGAACGTTCGAGATGA-3' (SEQ ID NO: 21).

40A. The vaccine composition of any one of embodiments 34A-36A, wherein the adjuvant comprises the sequence 5'-TCCATGACGTTCCTGATGCT-3' (SEQ ID NO: 22).

41A. The vaccine composition of any one of embodiments 34A-36A, wherein the adjuvant is ODN 1668.

42A. The vaccine composition of any one of embodiments 34A-36A, wherein the adjuvant is CpG 1018.

43A. The vaccine composition of any one of embodiments 30A-42A, wherein the SARS-CoV-2 genome comprises about 1 to about 30 oxidized guanine bases.

44A. The vaccine composition of any one of embodiments 43A, wherein the SARS-CoV-2 genome comprises about 20 oxidized guanine bases.

45A. The vaccine composition of any one of embodiments 30A-44A, wherein the composition comprises a pharmaceutically acceptable carrier or excipient.

46A. A method for treating or preventing a viral infection in a subject in need thereof, the method comprising administering to the subject an effective amount of the vaccine composition of any one of embodiments 16A-29A or 30A-45A.

47A. The method of embodiment 46A, wherein the subject is a mammal.

48A. The method of embodiment 47A, wherein the subject is a human.

49A. The method of any one of embodiments 46A-48A, wherein the vaccine is administered intramuscularly.

50A. The method of any one of embodiments 46A-48A, wherein the vaccine is administered subcutaneously.

51A. The method of any one of embodiments 46A-50A, wherein a first vaccine composition and a second vaccine composition are administered to the subject.

52A. The method of embodiment 51A, wherein the amount of viral protein in the first vaccine composition is greater than the amount of viral protein in the second vaccine composition.

53A. The method of embodiment 51A, wherein the amount of viral protein in the first vaccine composition is less than the amount of viral protein in the second vaccine composition.

54A. The method of embodiment 51A, wherein the amount of viral protein in the first vaccine composition is about the same as the amount of viral protein in the second vaccine composition.

55A. The method of any one of embodiments 51A-54A, wherein the second vaccine composition is administered about 1 week, about 2 weeks, about 3 weeks, about 4 weeks, about 2 months, about 3 months, about 4 months, about 5 months, about 6 months, or about 1 year after the first vaccine composition.

56A. The method of embodiment 55A, wherein the second vaccine composition is administered about 3 weeks after the first vaccine composition.

57A. A method for producing a viral vaccine, the method comprising (i) providing a plurality of viral particles, and (ii) inactivating the viral particles by contacting them with UV light in the presence of riboflavin.

58A. The method of embodiment 57A, wherein the method comprises purifying the inactivated viral particles.

59A. The method of embodiment 57A or 58A, wherein the viral particles are SARS-CoV-2 viral particles.

60A. A method for inactivating a SARS-CoV-2 viral particle, the method comprising contacting the SARS-CoV-2 viral particle with a dose of UV light in the presence of riboflavin; wherein the dose of UV light is about 100 Joules to about 1000 Joules; wherein the method comprises selectively oxidizing about 1 to about 30 guanine bases in a nucleic acid of the viral particle; and wherein the method does not comprise substantially altering the structure of antigens on the viral particle.

61A. The method of embodiment 60A, wherein the method comprises selectively oxidizing about 20 guanine bases in the nucleic acid of the viral particle.

62A. The method of any one of embodiments 60A-61A, wherein the nucleic acid of the viral particle is an RNA.

63A. A vaccine composition comprising an inactivated SARS-CoV-2 viral particle; wherein the composition comprises about 15 to about 50 picograms of viral protein and an adjuvant; and wherein the adjuvant is a phosphorothioate oligonucleotide comprising about 15 to about 30 nucleotides.

64A. The vaccine composition of embodiment 63A, wherein the composition comprises about 35 picograms of viral protein.

65A. The vaccine composition of any one of embodiments 63A-64A, wherein the adjuvant comprises the sequence 5'-TGACTGTGAACGTTCGAGATGA-3' (SEQ ID NO: 21).

66A. The vaccine composition of any one of embodiments 63A-64A, wherein the adjuvant comprises the sequence 5'-TCCATGACGTTCCTGATGCT-3' (SEQ ID NO: 22).

67A. The vaccine composition of any one of embodiments 63A-64A, wherein the adjuvant is ODN 1668.

68A. The vaccine composition of any one of embodiments 63A-64A, wherein the adjuvant is CpG 1018.

69A. A vaccine composition comprising an inactivated SARS-CoV-2 viral particle; wherein the SARS-CoV-2 genome comprises about 1 to about 30 oxidized guanine residues; wherein the structure of antigens on the viral particle is not substantially altered compared to SARS-CoV-2 viral particle that has not been inactivated.

70A. The vaccine composition of embodiment 69A, wherein the SARS-CoV-2 genome comprises about 20 oxidized guanine residues.

71A. The vaccine composition of any one of embodiments 69A-70A, wherein the composition comprises about 15 to about 50 picograms of viral protein.

72A. The vaccine composition of embodiment 71A, wherein the composition comprises about 35 picograms of viral protein.

73A. The vaccine composition of any one of embodiments 69A-72A, wherein the composition comprises an adjuvant.

74A. The vaccine composition of embodiment 73A, wherein the adjuvant is a phosphorothioate oligonucleotide comprising about 15 to about 30 nucleotides.

75A. The vaccine composition of embodiment 73A, wherein the adjuvant comprises the sequence 5'-TGACTGT-GAACGTTCGAGATGA-3' (SEQ ID NO: 21).

76A. The vaccine composition of embodiment 73A, wherein the adjuvant comprises the sequence 5'-TC-CATGACGTTCCTGATGCT-3' (SEQ ID NO: 22).

77A. The vaccine composition of embodiment 73A, wherein the adjuvant is ODN 1668.

78A. The vaccine composition of embodiment 73A, wherein the adjuvant is CpG 1018.

Embodiment Set B—Immunogenic Compositions

1B. An immunogenic composition comprising a polyclonal antibody that binds to a viral particle, wherein the polyclonal antibody is produced by administering to a host an inactivated viral particle, wherein the inactivation is performed by contacting the viral particle with a dose of UV light in the presence of riboflavin.

2B. The immunogenic composition of embodiment 1B, wherein the viral particle is an adenovirus particle, an adeno-associated virus (AAV) particle, a lentivirus particle, a coronavirus particle, or a retrovirus particle.

3B. The immunogenic composition of embodiment 1B, wherein the viral particle is a SARS-CoV-2 particle.

4B. The immunogenic composition of embodiment 1B, wherein the viral particle is a Dengue, Zika, African Swine Fever, Influenza, Marburg, Rabies, Human Immunodeficiency Virus (HIV), Smallpox, Hantavirus, Rotavirus, SARS-CoV, MERS-CoV, Cytomegalovirus (CMV), Ebola, Epstein-Barr, Herpes, Hepatitis, Human Papillomavirus, Mumps, Measles, Rubella, Polio, Varicella Zoster, Respiratory Syncytial Virus (RSV), Semliki Forest, West Nile, Yellow Fever, or Vesicular Stomatitis particle.

5B. The immunogenic composition of any one of embodiments 1B-4B, wherein the dose of UV light is about 100 Joules to about 1000 Joules.

6B. The immunogenic composition of embodiment 5B, wherein the dose of UV light is about 100 Joules.

7B. The immunogenic composition of any one of embodiments 11B-6B, wherein a nucleic acid of the viral particle comprises one or more modifications.

8B. The immunogenic composition of embodiment 7B, wherein the nucleic acid of the viral particle is a DNA or an RNA.

9B. The immunogenic composition of any one of embodiments 7B-8B, wherein the nucleic acid of the viral particle comprises oxidized guanine bases.

10B. The immunogenic composition of embodiment 9B, wherein the nucleic acid comprises about 1 to about 30 guanine bases.

11B. The immunogenic composition of any one of embodiments 1B-10B, wherein the inactivated viral particle is not capable of replicating in a cell.

12B. The immunogenic composition of any one of embodiments 1B-11B, wherein the inactivated viral particle is not capable of causing disease in a subject.

13B. The immunogenic composition of any one of embodiments 1B-12B, wherein the composition comprises an adjuvant.

14B. The immunogenic composition of any one of embodiments 1B-13B, wherein the composition comprises a pharmaceutically acceptable carrier or excipient.

15B. The immunogenic composition of any one of embodiments 1B-14B, wherein the host is a mammal.

16B. The immunogenic composition of embodiment 15B, wherein the host is a non-human primate, a bovine, an ovine, a caprine, an equine, a feline, a canine, a rodent or a lagomorph.

17B. The immunogenic composition of embodiment 15B, wherein the host is a human.

18B. The immunogenic composition of any one of embodiments 1B-14B, wherein the host is an avian.

19B. The immunogenic composition of embodiment 18B, wherein the host is a chicken, a duck, a goose, a quail, a turkey, a pheasant, a parrot, or a parakeet.

20B. A method of treating or preventing a disease or disorder in a subject in need thereof, the method comprising administering to a subject in need thereof an effective amount of the immunogenic composition of any one of embodiments 1B-19B.

21B. The method of embodiment 20B, wherein the inactivated viral particle is SARS-CoV-2, and the disease or disorder is COVID-19.

22B. The method of any one of embodiments 20B-21B, wherein the immunogenic composition is administered intravenously to the subject.

23B. The method of any one of embodiments 20B-21B, wherein the immunogenic composition is administered intramuscularly to the subject.

24B. The method of embodiment any one of embodiments 20B-23B, wherein the subject is a human.

25B. A method of producing a polyclonal antibody that binds to a viral particle, the method comprising: i) generating an inactivated viral particle by contacting the viral particle with a dose of UV light in the presence of riboflavin; ii) administering the inactivated viral particle to a host, wherein the host produces a polyclonal antibody; and iii) recovering the polyclonal antibody.

26B. The method of embodiment 25B, wherein the viral particle is a SARS-CoV-2 particle.

27B. The method of any one of embodiments 25B-26B, wherein the method comprises administering an adjuvant to the host.

28B. The method of any one of embodiments 25B-27B, wherein the host is a mammal.

29B. The method embodiment 28B, wherein the host is a non-human primate, a bovine, an ovine, a caprine, an equine, a feline, a canine, a rodent or a lagomorph.

30B. The method of embodiment 28B, wherein the host is a human.

31B. The method of any one of embodiments 25B-27B, wherein the host is an avian.

32B. The method of embodiment 31B, wherein the host is a chicken, a duck, a goose, a quail, a turkey, a pheasant, a parrot, or a parakeet.

33B. The method of embodiment 31B, wherein the host is a chicken, and the polyclonal antibody is recovered from an egg produced by the host.

34B. The method of embodiment any one of embodiments 25B-32B, wherein the polyclonal antibody is recovered from the blood of the host.

35B. The method of any one of embodiments 25B-32B, wherein the polyclonal antibody is recovered from B cells of the host.

36B. A polyclonal antibody produced by the method of any one of embodiments 25B-35B.

37B. A method of treating or preventing a disease or disorder in a subject in need thereof, the method comprising administering to a subject in need thereof an effective amount of the polyclonal antibody of embodiment 36B.

38B. A method of detecting the presence of a viral particle in a subject in need thereof, the method comprising: i) contacting a biological sample of the subject with the polyclonal antibody of embodiment 36B; and ii) detecting binding between the polyclonal antibody and the viral particle.

39B. The method of embodiment 38B, wherein the viral particle is a SARS-CoV-2 particle.

40B. The method of any one of embodiments 38B-39B, wherein the biological sample is whole blood, serum, plasma, urine, saliva, lymph fluid, bile, cerebrospinal fluid, nasal mucus, or stool.

41B. The method of any one of embodiments 38B-40B, wherein the polyclonal antibody is conjugated to a substrate.

42B. The method of embodiment 41B, wherein the substrate is a bead, a chip, a slide or a dish.

43B. The method of any one of embodiments 38B-42B, wherein the detecting step comprises contacting the polyclonal antibody with a secondary antibody that is conjugated to an enzyme or to a fluorophore.

Embodiment Set C—Immunogenic Compositions

1C. An inactivated SARS-CoV-2 viral particle coupled to a substrate.

2C. The inactivated SARS-CoV-2 viral particle of embodiment 1C, wherein the particle is inactivated using riboflavin and UV light.

3C. The inactivated SARS-CoV-2 viral particle of embodiment 1C or 2C, wherein the substrate is biological, nonbiological, organic, inorganic, or a combination thereof.

4C. The inactivated SARS-CoV-2 viral particle of any one of embodiments 1C-3C, wherein the substrate is a rigid support.

5C. The inactivated SARS-CoV-2 viral particle of any one of embodiments 1C-3C, wherein the substrate is a bead, a resin, a membrane, a fiber, a polymer, a matrix, a chip, a microplate or a tissue culture vessel.

6C. The inactivated SARS-CoV-2 viral particle of any one of embodiments 1C-5C, wherein the viral particle is coupled to the substrate via a linker.

7C. The inactivated SARS-CoV-2 viral particle of anyone of embodiments 1C-6C, wherein the inactivated viral particle is reversibly or irreversibly coupled to the substrate.

8C. Use of the inactivated SARS-CoV-2 viral particle of any one of embodiments 1C-7C in a method for detecting the presence of an antibody in a biological sample.

9C. A method for detecting an antibody (e.g., an anti-SARS-CoV-2 antibody) in a biological sample, the method comprising contacting the biological sample with a virus particle (e.g., a SARS-CoV-2 particle) that is coupled to a substrate.

10C. The method of embodiments 9C, wherein the antibody binds to the virus particle that is coupled to the substrate, thereby immobilizing the antibody.

11C. The method of embodiment 10C, wherein the method further comprises contacting the immobilized antibody with a second antibody, such as a detection antibody.

12C. The method of embodiment 11C, wherein the detection antibody is coupled to a fluorophore, or to an enzyme.

13C. An ELISA-based method for detecting an antibody in a biological sample, the method comprising contacting the biological sample with a virus particle (e.g., a SARS-CoV-2 particle) that is coupled to a substrate, thereby immobilizing the virus particle on the substrate, and detecting and/or quantifying the antibody.

14C. A method for detecting SARS-CoV-2-reactive antibodies in a biological sample of a subject in need thereof, the method comprising contacting the biological sample with an inactivated SARS-CoV-2 particle that is coupled to a substrate.

15C. The method of embodiment 14C, wherein the SARS-CoV-2 particle is inactivated using riboflavin and UV light.

16C. The method of embodiment 14C or 15C, wherein the method comprises detecting and/or quantifying the SARS-CoV-2 reactive antibodies.

Embodiment Set D—Inactivated SARS-CoV-2
Compositions and Methods

1D. A method for inactivating a SARS-CoV-2 particle, the method comprising contacting the SARS-CoV-2 particle with a dose of UV light in the presence of riboflavin.

2D. The method embodiment 1D, wherein the dose of UV light is about 100 Joules to about 1000 Joules.

3D. The method of embodiment 1 D, wherein the dose of UV light is about 100 Joules.

4D. The method of any one of embodiments 1 D-3D, wherein the method comprises altering a nucleic acid of the SARS-CoV-2 particle.

5D. The method of embodiment 4D, wherein the method comprises selectively oxidizing one or more guanine bases in the nucleic acid.

6D. The method of embodiment 5D, wherein the UV light selectively oxidizes about 1 to about 30 guanine bases in the nucleic acid of the SARS-CoV-2 particle.

7D. The method of embodiment 5D, wherein the UV light selectively oxidizes about 20 guanine bases in the nucleic acid of the SARS-CoV-2 particle.

8D. The method of any one of embodiments 4D-7D, wherein the nucleic acid of the SARS-CoV-2 particle is an RNA.

9D. The method of any one of embodiments 1 D-8D, wherein the method does not comprise substantially altering the structure of antigens on the surface of the SARS-CoV-2 particle.

10D. The method of any one of embodiments 1D-9D, wherein the inactivated SARS-CoV-2 particle is not capable of replicating in a cell.

11 D. The method of any one of embodiments 1 D-10D, wherein the inactivated SARS-CoV-2 particle is not capable of causing disease in a subject.

12D. A vaccine composition comprising a SARS-CoV-2 particle inactivated according to any one of embodiments 1 D-11 D.

13D. The vaccine composition of embodiment 12D, wherein the composition comprises about 1 to about 100 picograms of SARS-CoV-2 protein.

14D. The vaccine composition of embodiment 12D, wherein the composition comprises about 15 to about 50 picograms of SARS-CoV-2 protein.

15D. The vaccine composition of embodiment 12D, wherein the composition comprises about 35 picograms of SARS-CoV-2 protein.

16D. The vaccine composition of any one of embodiments 12D-15D, wherein the composition comprises an adjuvant.

17D. The vaccine composition of embodiment 16D, wherein the adjuvant is capable of promoting a Th1-type immune response.

18D. The vaccine composition of any one of embodiments 16D-17D, wherein the adjuvant is capable of limiting a Th2-type response.

19D. The vaccine composition of any one of embodiments 16D-17D, wherein the adjuvant is CpG and/or AS01.

20D. The vaccine composition of any one of embodiments 16D-17D, wherein the adjuvant is a phosphorothioate oligonucleotide comprising about 15 to about 30 nucleotides.

21D. The vaccine composition of any one of embodiments 16D-17D, wherein the adjuvant comprises a nucleic acid that comprises the sequence 5'-TGACTGT-GAACGTTCGAGATGA-3' (SEQ ID NO: 21).

22D. The vaccine composition of any one of embodiments 16D-17D, wherein the adjuvant comprises a nucleic acid that comprises the sequence 5'-TCCATGACGTTCCT-GATGCT-3' (SEQ ID NO: 22).

23D. The vaccine composition of any one of embodiments 16D-17D, wherein the adjuvant is ODN 1668.

24D. The vaccine composition of any one of embodiments 16D-17D, wherein the adjuvant is CpG 1018.

25D. The vaccine composition of any one of embodiments 16D-24D, wherein the composition comprises a pharmaceutically acceptable carrier or excipient.

26D. A vaccine composition comprising an inactivated SARS-CoV-2 viral particle, wherein the SARS-CoV-2 genome comprises one or more oxidized guanine residues.

27D. The vaccine composition of embodiment 26D, wherein the composition comprises about 1 to about 100 picograms of SARS-CoV-2 protein.

28D. The vaccine composition of embodiment 26D, wherein the composition comprises about 15 to about 50 picograms of SARS-CoV-2 protein.

29D. The vaccine composition of embodiment 26D, wherein the composition comprises about 35 picograms of SARS-CoV-2 protein.

30D. The vaccine composition of any one of embodiments 26D-29D, wherein the composition comprises an adjuvant.

31 D. The vaccine composition of embodiment 30, wherein the adjuvant is capable of promoting a Th1-type immune response.

32D. The vaccine composition of embodiment 30D or 31 D, wherein the adjuvant is capable of limiting a Th2-type response.

33D. The vaccine composition of any one of embodiments 30D-32D, wherein the adjuvant is CpG and/or AS01.

34D. The vaccine composition of any one of embodiments 30D-32D, wherein the adjuvant is a phosphorothioate oligonucleotide comprising about 15 to about 30 nucleotides.

35D. The vaccine composition of any one of embodiments 30D-32D, wherein the adjuvant comprises a nucleic acid that comprises the sequence 5'-TGACTGT-GAACGTTCGAGATGA-3' (SEQ ID NO: 21).

36D. The vaccine composition of any one of embodiments 30D-32D, wherein the adjuvant comprises a nucleic acid that comprises the sequence 5'-TCCATGACGTTCCT-GATGCT-3' (SEQ ID NO: 22).

37D. The vaccine composition of any one of embodiments 30D-32D, wherein the adjuvant is ODN 1668.

38D. The vaccine composition of any one of embodiments 30D-32D, wherein the adjuvant is CpG 1018.

39D. The vaccine composition of any one of embodiments 30D-38D, wherein the SARS-CoV-2 genome comprises about 1 to about 30 oxidized guanine bases.

40D. The vaccine composition of any one of embodiments 26D-39D, wherein the SARS-CoV-2 genome comprises about 20 oxidized guanine bases.

41 D. The vaccine composition of any one of embodiments 26D-40D, wherein the composition comprises a pharmaceutically acceptable carrier or excipient.

42D. A vaccine composition comprising an inactivated SARS-CoV-2 viral particle, and an adjuvant is capable of promoting a Th1-type immune response.

43D. The vaccine composition of embodiment 42D, wherein the composition comprises about 1 to about 100 picograms of SARS-CoV-2 protein.

44D. The vaccine composition of embodiment 42D, wherein the composition comprises about 15 to about 50 picograms of SARS-CoV-2 protein.

45D. The vaccine composition of embodiment 42D, wherein the composition comprises about 35 picograms of SARS-CoV-2 protein.

46D. The vaccine composition of any one of embodiments 42D-45D, wherein the adjuvant is capable of limiting a Th2-type response.

47D. The vaccine composition of any one of embodiments 42D-46D, wherein the adjuvant is CpG and/or AS01.

48D. The vaccine composition of any one of embodiments 42D-46D, wherein the adjuvant is a phosphorothioate oligonucleotide comprising about 15 to about 30 nucleotides.

49D. The vaccine composition of any one of embodiments 42D-46D, wherein the adjuvant comprises a nucleic acid that comprises the sequence 5'-TGACTGT-GAACGTTCGAGATGA-3' (SEQ ID NO: 21).

50D. The vaccine composition of any one of embodiments 42D-46D, wherein the adjuvant comprises a nucleic acid that comprises the sequence 5'-TCCATGACGTTCCT-GATGCT-3' (SEQ ID NO: 22).

51D. The vaccine composition of any one of embodiments 42D-46D, wherein the adjuvant is ODN 1668.

52D. The vaccine composition of any one of embodiments 42D-46D, wherein the adjuvant is CpG 1018.

53D. The vaccine composition of any one of embodiments 42D-52D, wherein the SARS-CoV-2 genome comprises about 1 to about 30 oxidized guanine bases.

54D. The vaccine composition of any one of embodiments 42D-52D, wherein the SARS-CoV-2 genome comprises about 20 oxidized guanine bases.

55D. The vaccine composition of any one of embodiments 42D-52D, wherein the composition comprises a pharmaceutically acceptable carrier or excipient.

56D. A method for treating or preventing a viral infection in a subject in need thereof, the method comprising administering to the subject an effective amount of the vaccine composition of any one of embodiments 12D-55D.

57D. The method of embodiment 56D, wherein the subject is a mammal.

58D. The method of embodiment 57D, wherein the subject is a human.

59D. The method of any one of embodiments 56D-58D, wherein the vaccine is administered intramuscularly.

60D. The method of any one of embodiments 56D-59D, wherein the vaccine is administered subcutaneously.

61 D. The method of any one of embodiments 56D-60D, wherein a first vaccine composition and a second vaccine composition are administered to the subject.

62D. The method of embodiment 61 D, wherein the amount of viral protein in the first vaccine composition is greater than the amount of viral protein in the second vaccine composition.

63D. The method of embodiment 61 D, wherein the amount of viral protein in the first vaccine composition is less than the amount of viral protein in the second vaccine composition.

64D. The method of embodiment 61 D, wherein the amount of viral protein in the first vaccine composition is about the same as the amount of viral protein in the second vaccine composition.

65D. The method of any one of embodiments 61 D-64D, wherein the second vaccine composition is administered about 1 week, about 2 weeks, about 3 weeks, about 4 weeks, about 2 months, about 3 months, about 4 months, about 5 months, about 6 months, or about 1 year after the first vaccine composition.

66D. The method of embodiment 65D, wherein the second vaccine composition is administered about 3 weeks after the first vaccine composition.

67D. A method for producing a viral vaccine, the method comprising (i) providing a plurality of SARS-CoV-2 particles, and (ii) inactivating the particles by contacting them with UV light in the presence of riboflavin.

68D. The method of embodiment 67D, wherein the method comprises purifying the inactivated SARS-CoV-2 particles.

69D. A method for inactivating a SARS-CoV-2 viral particle, the method comprising contacting the SARS-CoV-2 viral particle with a dose of UV light in the presence of riboflavin; wherein the dose of UV light is about 100 Joules to about 1000 Joules; wherein the method comprises selectively oxidizing about 1 to about 30 guanine bases in a nucleic acid of the viral particle; and wherein the method does not comprise substantially altering the structure of antigens on the viral particle.

70D. The method of embodiment 69D, wherein the method comprises selectively oxidizing about 20 guanine bases in the nucleic acid of the viral particle.

71D. The method of any one of embodiments 69D-70D, wherein the nucleic acid of the viral particle is a RNA.

72D. A vaccine composition comprising an inactivated SARS-CoV-2 viral particle; wherein the composition comprises about 15 to about 50 picograms of SARS-CoV-2 protein and an adjuvant; and wherein the adjuvant is a phosphorothioate oligonucleotide comprising about 15 to about 30 nucleotides.

73. The vaccine composition of embodiment 72D, wherein the composition comprises about 35 picograms of SARS-CoV-2 protein.

74D. The vaccine composition of any one of embodiments 72D-73D, wherein the adjuvant comprises a nucleic acid comprising the sequence 5'-TGACTGT-GAACGTTCGAGATGA-3' (SEQ ID NO: 21).

75D. The vaccine composition of any one of embodiments 72D-74D, wherein the adjuvant comprises the sequence 5'-TCCATGACGTTCCTGATGCT-3' (SEQ ID NO: 22).

76D. The vaccine composition of any one of embodiments 72D-75D, wherein the adjuvant is ODN 1668.

77D. The vaccine composition of any one of embodiments 72D-75D, wherein the adjuvant is CpG 1018.

78D. A vaccine composition comprising an inactivated SARS-CoV-2 viral particle; wherein the SARS-CoV-2 genome comprises about 1 to about 30 oxidized guanine residues; wherein the structure of antigens on the viral particle is not substantially altered compared to SARS-CoV-2 viral particle that has not been inactivated.

79D. The vaccine composition of embodiment 78D, wherein the SARS-CoV-2 genome comprises about 20 oxidized guanine residues.

80D. The vaccine composition of embodiment 78D, wherein the composition comprises about 15 to about 50 picograms of SARS-CoV-2 protein.

81D. The vaccine composition of embodiment 78D, wherein the composition comprises about 35 picograms of SARS-CoV-2 protein.

82. The vaccine composition of any one of embodiments 78-81, wherein the composition comprises an adjuvant.

83. The vaccine composition of embodiment 82, wherein the adjuvant is a phosphorothioate oligonucleotide comprising about 15 to about 30 nucleotides.

84. The vaccine composition of embodiment 83, wherein the adjuvant comprises the sequence 5'-TGACTGT-GAACGTTCGAGATGA-3' (SEQ ID NO: 21).

85. The vaccine composition of embodiment 83, wherein the adjuvant comprises the sequence 5'-TC-CATGACGTTCCTGATGCT-3' (SEQ ID NO: 22).

86. The vaccine composition of embodiment 83, wherein the adjuvant is ODN 1668.

87. The vaccine composition of embodiment 83, wherein the adjuvant is CpG 1018.

66

5. The vaccine composition of claim 1, wherein the SARS-CoV-2 genome comprises about 1 to about 30 oxidized guanine bases caused by the dose of UV light in the presence of the exogenous riboflavin.

6. The vaccine composition of claim 1, wherein the SARS-CoV-2 genome comprises about 20 oxidized guanine bases caused by the dose of UV light in the presence of the exogenous riboflavin.

7. A vaccine composition comprising an inactivated Severe Acute Respiratory Syndrome Coronavirus 2 (SARS-CoV-2) viral particle; wherein the composition comprises at least 100 picograms or more of SARS-CoV-2 spike protein; an adjuvant capable of promoting a Th1-type immune response; and a pharmaceutically acceptable carrier or excipient; wherein the adjuvant is a phosphorothioate oligonucleotide comprising about 15 to about 30 nucleotides, wherein the SARS-CoV-2 viral particle is inactivated by exposure to a dose of UV light in the presence of exogenous riboflavin in a buffered solution, and wherein the dose of UV light is from 0.5 Joules/mL to 3.0 Joules/mL of the vaccine composition.

8. The vaccine composition of claim 7, wherein the adjuvant selected from: ODN 1668, CpG 1018, a nucleic

SEQUENCE LISTING (24 sequences)

SEQ ID NO: 1 - DNA, 29903 bp, Betacoronavirus Severe acute respiratory syndrome coronavirus 2
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagctcgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactctttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgtttaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgacaaaaaaaaaaaaaaaaaaaaaaaaaaaaaaaaa

SEQ ID NO: 2 - DNA, 29082 bp, Betacoronavirus Severe acute respiratory syndrome coronavirus 2
tttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggttttgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacatcttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactccatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttttaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacacctcgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacatactcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacatactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacttacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagctcgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactctttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattgggaacatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcatagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttttagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgtttaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagccgcaacagttcaaaaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccc

SEQ ID NO: 3 - DNA, 29663 bp, Betacoronavirus Severe acute respiratory syndrome coronavirus 2
gtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcactaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaagttatcttcttagagggagaaacacttcccacagaagtgttaacagaggaagttgtcttgaaaactggtgatttacaatcattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttttatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactattatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagctcgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactctttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacgtttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatacaattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgtttaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagc

SEQ ID NO: 4 - DNA, 29829 bp, Betacoronavirus Severe acute respiratory syndrome coronavirus 2
ccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgattttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagtcagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagatacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagctcgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactctttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattactccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctttcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcagcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaataaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttgaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgccgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcctggatgaggctggttctaaatcacccattcagtacatcgatatcggtaattatacagtttcctgttcaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgac

SEQ ID NO: 5 - DNA, 29895 bp, Betacoronavirus Severe acute respiratory syndrome coronavirus 2
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggttttgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacatcttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttttaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggagtttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagtttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacttacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagctcgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactctttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcatagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagttatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgtttaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgacaaaaaaaaaaaaaaaaaaaaaaaaa

SEQ ID NO: 6 - DNA, 29897 bp, Betacoronavirus Severe acute respiratory syndrome coronavirus 2
taaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgactaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcatgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacacgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagtggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgcctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagctcgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactctttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttatattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgtttaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgacaaaaaaaaaaaaaaaaaaaaaaaaaaaaaaaa

SEQ ID NO: 7 - DNA, 29800 bp, Betacoronavirus Severe acute respiratory syndrome coronavirus 2
tcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggttttgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttttaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgatattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttcttggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacttacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagctcgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactctttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattctttttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgtttaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgt

SEQ ID NO: 8 - DNA, 29800 bp, Betacoronavirus Severe acute respiratory syndrome coronavirus 2
tcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggttttgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttttaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgttttttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacttacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagctcgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactctttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtttagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcatagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttatagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgtttaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgt

SEQ ID NO: 9 - DNA, 29800 bp, Betacoronavirus Severe acute respiratory syndrome coronavirus 2
tcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgctacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagtcagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaaaactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagctcgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactctttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtactttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcattccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgttcaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcaataggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacacggagtacgatcgagtgtacagtgaacaatgctagggagagctgcctatatggaagagccctaatgtgtaaaattaattttagtagtgctatccccatgt

SEQ ID NO: 10 - DNA, 29800 bp, Betacoronavirus Severe acute respiratory syndrome coronavirus 2
tcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggttttgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttttaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagataatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagttttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgttttttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacttacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagctcgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactctttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtttagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcatagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttatagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgtttaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgt

SEQ ID NO: 11 - DNA, 29800 bp, Betacoronavirus Severe acute respiratory syndrome coronavirus 2
tcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggttttgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttttaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgatattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatttacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacttacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagctcgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactctttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgtttaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgt

SEQ ID NO: 12 - DNA, 29800 bp, Betacoronavirus Severe acute respiratory syndrome coronavirus 2
tcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggttttgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttttaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgatattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacttacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagctcgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactctttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgtttaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgt

SEQ ID NO: 13 - DNA, 29659 bp, Betacoronavirus Severe acute respiratory syndrome coronavirus 2
tcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgctacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagtcagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttcccaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaaaactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagctcgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactctttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgctaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtactttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcattccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgttcaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcaataggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacacggagtacgatcgagtgtacagtgaacaatgctagggagagctgcctatatggaagagccctaatgtgtaaaattaattttagtagtgctatccccatgt

SEQ ID NO: 14 - DNA, 29800 bp, Betacoronavirus Severe acute respiratory syndrome coronavirus 2
tcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggttttgtccgggtgtgaccgaaaggtaagatggagagccttgtccctggtttcaacgagaaaacacacgtccaactcagtttgcctgttttacaggttcgcgacgtgctcgtacgtggctttggagactccgtggaggagttcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttttaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgatattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacttacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagctcgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactctttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgtttaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgt

SEQ ID NO: 15 - DNA, 29800 bp, Betacoronavirus Severe acute respiratory syndrome coronavirus 2; identical to SEQ ID NO: 12

SEQ ID NO: 16 - DNA, 29800 bp, Betacoronavirus Severe acute respiratory syndrome coronavirus 2
tcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggttttgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttttaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagttttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgttttttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacttacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagctcgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactctttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtttagctgtccatgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcatagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttatagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgtttaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgt

SEQ ID NO: 17 - DNA, 29800 bp, Betacoronavirus Severe acute respiratory syndrome coronavirus 2
tcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggttttgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttttaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactggcaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgatattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagccagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacttacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagctcgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactctttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaatacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgtttaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgt

SEQ ID NO: 18 - DNA, 29800 bp, Betacoronavirus Severe acute respiratory syndrome coronavirus 2; identical to SEQ ID NO: 12

SEQ ID NO: 19 - DNA, 29800 bp, Betacoronavirus Severe acute respiratory syndrome coronavirus 2; identical to SEQ ID NO: 8

SEQ ID NO: 20 - DNA, 29870 bp, Betacoronavirus Severe acute respiratory syndrome coronavirus 2
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagtcagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgaggaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagctcgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactttttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtcatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacatagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtattattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgttcaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagtacaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgac

SEQ ID NO: 21 - DNA, 22 bp, Artificial Sequence
  CpG 1018 oligonucleotide
tgactgtgaacgttcgagatga

SEQ ID NO: 22 - DNA, 20 bp, Artificial Sequence
  ODN 1688 oligonucleotide
tccatgacgttcctgatgct

SEQ ID NO: 23 - DNA, 29882 bp, SARS-CoV-2
attaaaggtttataccttcccaggtaacaaaccaaccaactttcgatctcttgtagatctgttctctaaacgaactttaaaatctgtgtggctgtcactcggctgcatgcttagtgcactcacgcagtataattaataactaattactgtcgttgacaggacacgagtaactcgtctatcttctgcaggctgcttacggtttcgtccgtgttgcagccgatcatcagcacatctaggtttcgtccgggtgtgaccgaaaggtaagatggagagccttgtccctggtttcaacgagaaaacacacgtccaactcagtttgcctgttttacaggttcgcgacgtgctcgtacgtggctttggagactccgtggaggaggtcttatcagaggcacgtcaacatcttaaagatggcacttgtggcttagtagaagttgaaaaaggcgttttgcctcaacttgaacagccctatgtgttcatcaaacgttcggatgctcgaactgcacctcatggtcatgttatggttgagctggtagcagaactcgaaggcattcagtacggtcgtagtggtgagacacttggtgtccttgtccctcatgtgggcgaaataccagtggcttaccgcaaggttcttcttcgtaagaacggtaataaaggagctggtggccatagttacggcgccgatctaaagtcatttgacttaggcgacgagcttggcactgatccttatgaagattttcaagaaaactggaacactaaacatagcagtggtgttacccgtgaactcatgcgtgagcttaacggaggggcatacactcgctatgtcgataacaacttctgtggccctgatggctaccctcttgagtgcattaaagaccttctagcacgtgctggtaaagcttcatgcactttgtccgaacaactggactttattgacactaagaggggtgtatactgctgccgtgaacatgagcatgaaattgcttggtacacggaacgttctgaaaagagctatgaattgcagacaccttttgaaattaaattggcaaagaaatttgacaccttcaatggggaatgtccaaattttgtatttcccttaaattccataatcaagactattcaaccaagggttgaaaagaaaaagcttgatggctttatgggtagaattcgatctgtctatccagttgcgtcaccaaatgaatgcaaccaaatgtgcctttcaactctcatgaagtgtgatcattgtggtgaaacttcatggcagacgggcgattttgttaaagccacttgcgaattttgtggcactgagaatttgactaaagaaggtgccactacttgtggttacttaccccaaaatgctgttgttaaaatttattgtccagcatgtcacaattcagaagtaggacctgagcatagtcttgccgaataccataatgaatctggcttgaaaaccattcttcgtaagggtggtcgcactattgcctttggaggctgtgtgttctcttatgttggttgccataacaagtgtgcctattgggttccacgtgctagcgctaacataggttgtaaccatacaggtgttgttggagaaggttccgaaggtcttaatgacaaccttcttgaaatactccaaaaagagaaagtcaacatcaatattgttggtgactttaaacttaatgaagagatcgccattattttggcatctttttctgcttccacaagtgcttttgtggaaactgtgaaaggtttggattataaagcattcaaacaaattgttgaatcctgtggtaattttaaagttacaaaaggaaaagctaaaaaaggtgcctggaatattggtgaacagaaatcaatactgagtcctctttatgcatttgcatcagaggctgctcgtgttgtacgatcaattttctcccgcactcttgaaactgctcaaaattctgtgcgtgttttacagaaggccgctataacaatactagatggaatttcacagtattcactgagactcattgatgctatgatgttcacatctgatttggctactaacaatctagttgtaatggcctacattacaggtggtgttgttcagttgacttcgcagtggctaactaacatctttggcactgtttatgaaaaactcaaacccgtccttgattggcttgaagagaagtttaaggaaggtgtagagtttcttagagacggttgggaaattgttaaatttatctcaacctgtgcttgtgaaattgtcggtggacaaattgtcacctgtgcaaaggaaattaaggagagtgttcagacattctttaagcttgtaaataaatttttggctttgtgtgctgactctatcattattggtggagctaaacttaaagccttgaatttaggtgaaacatttgtcacgcactcaaagggattgtacagaaagtgtgttaaatccagagaagaaactggcctactcatgcctctaaaagccccaaaagaaattatcttcttagagggagaaacacttcccacagaagtgttaacagaggaagttgtcttgaaaactggtgatttacaaccattagaacaacctactagtgaagctgttgaagctccattggttggtacaccagtttgtattaacgggcttatgttgctcgaaatcaaagacacagaaaagtactgtgcccttgcacctaatatgatggtaacaaacaataccttcacactcaaaggcggtgcaccaacaaaggttacttttggtgatgacactgtgatagaagtgcaaggttacaagagtgtgaatatcacttttgaacttgatgaaaggattgataaagtacttaatgagaagtgctctgcctatacagttgaactcggtacagaagtaaatgagttcgcctgtgttgtggcagatgctgtcataaaaactttgcaaccagtatctgaattacttacaccactgggcattgatttagatgagtggagtatggctacatactacttatttgatgagtctggtgagtttaaattggcttcacatatgtattgttctttctaccctccagatgaggatgaagaagaaggtgattgtgaagaagaagagtttgagccatcaactcaatatgagtatggtactgaagatgattaccaaggtaaacctttggaatttggtgccacttctgctgctcttcaacctgaagaagagcaagaagaagattggttagatgatgatagtcaacaaactgttggtcaacaagacggcagtgaggacaatcagacaactactattcaaacaattgttgaggttcaacctcaattagagatggaacttacaccagttgttcagactattgaagtgaatagttttagtggttatttaaaacttactgacaatgtatacattaaaaatgcagacattgtggaagaagctaaaaaggtaaaaccaacagtggttgttaatgcagccaatgtttaccttaaacatggaggaggtgttgcaggagccttaaataaggctactaacaatgccatgcaagttgaatctgatgattacatagctactaatggaccacttaaagtgggtggtagttgtgttttaagcggacacaatcttgctaaacactgtcttcatgttgtcggcccaaatgttaacaaaggtgaagacattcaacttcttaagagtgcttatgaaaattttaatcagcacgaagttctacttgcaccattattatcagctggtatttttggtgctgaccctatacattctttaagagtttgtgtagatactgttcgcacaaatgtctacttagctgtctttgataaaaatctctatgacaaacttgtttcaagctttttggaaatgaagagtgaaaagcaagttgaacaaaagatcgctgagattcctaaagaggaagttaagccatttataactgaaagtaaaccttcagttgaacagagaaaacaagatgataagaaaatcaaagcttgtgttgaagaagttacaacaactctggaagaaactaagttcctcacagaaaacttgttactttatattgacattaatggcaatcttcatccagattctgccactcttgttagtgacattgacatcactttcttaaagaaagatgctccatatatagtgggtgatgttgttcaagagggtgttttaactgctgtggttatacctactaaaaaggctggtggcactactgaaatgctagcgaaagctttgagaaaagtgccaacagacaattatataaccacttacccgggtcagggtttaaatggttacactgtagaggaggcaaagacagtgcttaaaaagtgtaaaagtgccttttacattctaccatctattatctctaatgagaagcaagaaattcttggaactgtttcttggaatttgcgagaaatgcttgcacatgcagaagaaacacgcaaattaatgcctgtctgtgtggaaactaaagccatagtttcaactatacagcgtaaatataagggtattaaaatacaagagggtgtggttgattatggtgctagattttacttttacaccagtaaaacaactgtagcgtcacttatcaacacacttaacgatctaaatgaaactcttgttacaatgccacttggctatgtaacacatggcttaaatttggaagaagctgctcggtatatgagatctctcaaagtgccagctacagtttctgtttcttcacctgatgctgttacagcgtataatggttatcttacttcttcttctaaaacacctgaagaacattttattgaaaccatctcacttgctggttcctataaagattggtcctattctggacaatctacacaactaggtatagaatttcttaagagaggtgataaaagtgtatattacactagtaatcctaccacattccacctagatggtgaagttatcacctttgacaatcttaagacacttctttctttgagagaagtgaggactattaaggtgtttacaacagtagacaacattaacctccacacgcaagttgtggacatgtcaatgacatatggacaacagtttggtccaacttatttggatggagctgatgttactaaaataaaacctcataattcacatgaaggtaaaacattttatgttttacctaatgatgacactctacgtgttgaggcttttgagtactaccacacaactgatcctagttttctgggtaggtacatgtcagcattaaatcacactaaaaagtggaaatacccacaagttaatggtttaacttctattaaatgggcagataacaactgttatcttgccactgcattgttaacactccaacaaatagagttgaagtttaatccacctgctctacaagatgcttattacagagcaagggctggtgaagctgctaacttttgtgcacttatcttagcctactgtaataagacagtaggtgagttaggtgatgttagagaaacaatgagttacttgtttcaacatgccaatttagattcttgcaaaagagtcttgaacgtggtgtgtaaaacttgtggacaacagcagacaacccttaagggtgtagaagctgttatgtacatgggcacactttcttatgaacaatttaagaaaggtgttcagataccttgtacgtgtggtaaacaagctacaaaatatctagtacaacaggagtcaccttttgttatgatgtcagcaccacctgctcagtatgaacttaagcatggtacatttacttgtgctagtgagtacactggtaattaccagtgtggtcactataaacatataacttctaaagaaactttgtattgcatagacggtgctttacttacaaagtcctcagaatacaaaggtcctattacggatgttttctacaaagaaaacagttacacaacaaccataaaaccagttacttataaattggatggtgttgtttgtacagaaattgaccctaagttggacaattattataagaaagacaattcttatttcacagagcaaccaattgatcttgtaccaaaccaaccatatccaaacgcaagcttcgataattttaagtttgtatgtgataatatcaaatttgctgatgatttaaaccagttaactggttataagaaacctgcttcaagagagcttaaagttacatttttccctgacttaaatggtgatgtggtggctattgattataaacactacacaccctcttttaagaaaggagctaaattgttacataaacctattgtttggcatgttaacaatgcaactaataaagccacgtataaaccaaatacctggtgtatacgttgtctttggagcacaaaaccagttgaaacatcaaattcgtttgatgtactgaagtcagaggacgcgcagggaatggataatcttgcctgcgaagatctaaaaccagtctctgaagaagtagtggaaaatcctaccatacagaaagacgttcttgagtgtaatgtgaaaactaccgaagttgtaggagacattatacttaaaccagcaaataatagtttaaaaattacagaagaggttggccacacagatctaatggctgcttatgtagacaattctagtcttactattaagaaacctaatgaattatctagagtattaggtttgaaaacccttgctactcatggtttagctgctgttaatagtgtcccttgggatactatagctaattatgctaagccttttcttaacaaagttgttagtacaactactaacatagttacacggtgtttaaaccgtgtttgtactaattatatgccttatttctttactttattgctacaattgtgtacttttactagaagtacaaattctagaattaaagcatctatgccgactactatagcaaagaatactgttaagagtgtcggtaaattttgtctagaggcttcatttaattatttgaagtcacctaatttttctaaactgataaatattataatttggtttttactattaagtgtttgcctaggttctttaatctactcaaccgctgctttaggtgttttaatgtctaatttaggcatgccttcttactgtactggttacagagaaggctatttgaactctactaatgtcactattgcaacctactgtactggttctataccttgtagtgtttgtcttagtggtttagattctttagacacctatccttctttagaaactatacaaattaccatttcatcttttaaatgggatttaactgcttttggcttagttgcagagtggtttttggcatatattcttttcactaggtttttctatgtacttggattggctgcaatcatgcaattgtttttcagctattttgcagtacattttattagtaattcttggcttatgtggttaataattaatcttgtacaaatggccccgatttcagctatggttagaatgtacatcttctttgcatcattttattatgtatggaaaagttatgtgcatgttgtagacggttgtaattcatcaacttgtatgatgtgttacaaacgtaatagagcaacaagagtcgaatgtacaactattgttaatggtgttagaaggtccttttatgtctatgctaatggaggtaaaggcttttgcaaactacacaattggaattgtgttaattgtgatacattctgtgctggtagtacatttattagtgatgaagttgcgagagacttgtcactacagtttaaaagaccaataaatcctactgaccagtcttcttacatcgttgatagtgttacagtgaagaatggttccatccatctttactttgataaagctggtcaaaagacttatgaaagacattctctctctcattttgttaacttagacaacctgagagctaataacactaaaggttcattgcctattaatgttatagtttttgatggtaaatcaaaatgtgaagaatcatctgcaaaatcagcgtctgtttactacagtcagcttatgtgtcaacctatactgttactagatcaggcattagtgtctgatgttggtgatagtgcggaagttgcagttaaaatgtttgatgcttacgttaatacgttttcatcaacttttaacgtaccaatggaaaaactcaaaacactagttgcaactgcagaagctgaacttgcaaagaatgtgtccttagacaatgtcttatctacttttatttcagcagctcggcaagggtttgttgattcagatgtagaaactaaagatgttgttgaatgtcttaaattgtcacatcaatctgacatagaagttactggcgatagttgtaataactatatgctcacctataacaaagttgaaaacatgacaccccgtgaccttggtgcttgtattgactgtagtgcgcgtcatattaatgcgcaggtagcaaaaagtcacaacattgctttgatatggaacgttaaagatttcatgtcattgtctgaacaactacgaaaacaaatacgtagtgctgctaaaaagaataacttaccttttaagttgacatgtgcaactactagacaagttgttaatgttgtaacaacaaagatagcacttaagggtggtaaaattgttaataattggttgaagcagttaattaaagttacacttgtgttcctttttgttgctgctattttctatttaataacacctgttcatgtcatgtctaaacatactgacttttcaagtgaaatcataggatacaaggctattgatggtggtgtcactcgtgacatagcatctacagatacttgttttgctaacaaacatgctgattttgacacatggtttagtcagcgtggtggtagttatactaatgacaaagcttgcccattgattgctgcagtcataacaagagaagtgggttttgtcgtgcctggtttgcctggcacgatattacgcacaactaatggtgactttttgcatttcttacctagagtttttagtgcagttggtaacatctgttacacaccatcaaaacttatagagtacactgactttgcaacatcagcttgtgttttggctgctgaatgtacaatttttaaagatgcttctggtaagccagtaccatattgttatgataccaatgtactagaaggttctgttgcttatgaaagtttacgccctgacacacgttatgtgctcatggatggctctattattcaatttcctaacacctaccttgaaggttctgttagagtggtaacaacttttgattctgagtactgtaggcacggcacttgtgaaagatcagaagctggtgtttgtgtatctactagtggtagatgggtacttaacaatgattattacagatctttaccaggagttttctgtggtgtagatgctgtaaatttacttactaatatgtttacaccactaattcaacctattggtgctttggacatatcagcatctatagtagctggtggtattgtagctatcgtagtaacatgccttgcctactattttatgaggtttagaagagcttttggtgaatacagtcatgtagttgcctttaatactttactattccttatgtcattcactgtactctgtttaacaccagtttactcattcttacctggtgtttattctgttatttacttgtacttgacattttatcttactaatgatgtttcttttttagcacatattcagtggatggttatgttcacacctttagtacctttctggataacaattgcttatatcatttgtatttccacaaagcatttctattggttctttagtaattacctaaagagacgtgtagtctttaatggtgtttcctttagtacttttgaagaagctgcgctgtgcacctttttgttaaataaagaaatgtatctaaagttgcgtagtgatgtgctattacctcttacgcaatataatagatacttagctctttataataagtacaagtattttagtggagcaatggatacaactagctacagagaagctgcttgttgtcatctcgcaaaggctctcaatgacttcagtaactcaggttctgatgttctttaccaaccaccacaaacctctatcacctcagctgttttgcagagtggttttagaaaaatggcattcccatctggtaaagttgagggttgtatggtacaagtaacttgtggtacaactacacttaacggtctttggcttgatgacgtagtttactgtccaagacatgtgatctgcacctctgaagacatgcttaaccctaattatgaagatttactcattcgtaagtctaatcataatttcttggtacaggctggtaatgttcaactcagggttattggacattctatgcaaaattgtgtacttaagcttaaggttgatacagccaatcctaagacacctaagtataagtttgttcgcattcaaccaggacagactttttcagtgttagcttgttacaatggttcaccatctggtgtttaccaatgtgctatgaggcccaatttcactattaagggttcattccttaatggttcatgtggtagtgttggttttaacatagattatgactgtgtctctttttgttacatgcaccatatggaattaccaactggagttcatgctggcacagacttagaaggtaacttttatggaccttttgttgacaggcaaacagcacaagcagctggtacggacacaactattacagttaatgttttagcttggttgtacgctgctgttataaatggagacaggtggtttctcaatcgatttaccacaactcttaatgactttaaccttgtggctatgaagtacaattatgaacctctaacacaagaccatgttgacatactaggacctctttctgctcaaactggaattgccgttttagatatgtgtgcttcattaaaagaattactgcaaaatggtatgaatggacgtaccatattgggtagtgctttattagaagatgaatttacaccttttgatgttgttagacaatgctcaggtgttactttccaaagtgcagtgaaaagaacaatcaagggtacacaccactggttgttactcacaattttgacttcacttttagttttagtccagagtactcaatggtctttgttcttttttttgtatgaaaatgcctttttaccttttgctatgggtattattgctatgtctgcttttgcaatgatgtttgtcaaacataagcatgcatttctctgtttgtttttgttaccttctcttgccactgtagcttattttaatatggtctatatgcctgctagttgggtgatgcgtattatgacatggttggatatggttgatactagtttgtctggttttaagctaaaagactgtgttatgtatgcatcagctgtagtgttactaatccttatgacagcaagaactgtgtatgatgatggtgctaggagagtgtggacacttatgaatgtcttgacactcgtttataaagtttattatggtaatgctttagatcaagccatttccatgtgggctcttataatctctgttacttctaactactcaggtgtagttacaactgtcatgtttttggccagaggtattgtttttatgtgtgttgagtattgccctattttcttcataactggtaatacacttcagtgtataatgctagtttattgtttcttaggctatttttgtacttgttactttggcctcttttgtttactcaaccgctactttagactgactcttggtgtttatgattacttagtttctacacaggagtttagatatatgaattcacagggactactcccacccaagaatagcatagatgccttcaaactcaacattaaattgttgggtgttggtggcaaaccttgtatcaaagtagccactgtacagtctaaaatgtcagatgtaaagtgcacatcagtagtcttactctcagttttgcaacaactcagagtagaatcatcatctaaattgtgggctcaatgtgtccagttacacaatgacattctcttagctaaagatactactgaagcctttgaaaaaatggtttcactactttctgttttgctttccatgcagggtgctgtagacataaacaagctttgtgaagaaatgctggacaacagggcaaccttacaagctatagcctcagagtttagttcccttccatcatatgcagcttttgctactgctcaagaagcttatgagcaggctgttgctaatggtgattctgaagttgttcttaaaaagttgaagaagtctttgaatgtggctaaatctgaatttgaccgtgatgcagccatgcaacgtaagttggaaaagatggctgatcaagctatgacccaaatgtataaacaggctagatctgaggacaagagggcaaaagttactagtgctatgcagacaatgcttttcactatgcttagaaagttggataatgatgcactcaacaacattatcaacaatgcaagagatggttgtgttcccttgaacataatacctcttacaacagcagccaaactaatggttgtcataccagactataacacatataaaaatacgtgtgatggtacaacatttacttatgcatcagcattgtgggaaatccaacaggttgtagatgcagatagtaaaattgttcaacttagtgaaattagtatggacaattcacctaatttagcatggcctcttattgtaacagctttaagggccaattctgctgtcaaattacagaataatgagcttagtcctgttgcactacgacagatgtcttgtgctgccggtactacacaaactgcttgcactgatgacaatgcgttagcttactacaacacaacaaagggaggtaggtttgtacttgcactgttatccgatttacaggatttgaaatgggctagattccctaagagtgatggaactggtactatctatacagaactggaaccaccttgtaggtttgttacagacacacctaaaggtcctaaagtgaagtatttatactttattaaaggattaaacaacctaaatagaggtatggtacttggtagtttagctgccacagtacgtctacaagctggtaatgcaacagaagtgcctgccaattcaactgtattatctttctgtgcttttgctgtagatgctgctaaagcttacaaagattatctagctagtgggggacaaccaatcactaattgtgttaagatgttgtgtacacacactggtactggtcaggcaataacagttacaccggaagccaatatggatcaagaatcctttggtggtgcatcgtgttgtctgtactgccgttgccacatagatcatccaaatcctaaaggattttgtgacttaaaaggtaagtatgtacaaatacctacaacttgtgctaatgaccctgtgggttttacacttaaaaacacagtctgtaccgtctgcggtatgtggaaaggttatggctgtagttgtgatcaactccgcgaacccatgcttcagtcagctgatgcacaatcgtttttaaacgggtttgcggtgtaagtgcagcccgtcttacaccgtgcggcacaggcactagtactgatgtcgtatacagggcttttgacatctacaatgataaagtagctggttttgctaaattcctaaaaactaattgttgtcgcttccaagaaaaggacgaagatgacaatttaattgattcttactttgtagttaagagacacactttctctaactaccaacatgaagaaacaatttataatttacttaaggattgtccagctgttgctaaacatgacttctttaagtttagaatagacggtgacatggtaccacatatatcacgtcaacgtcttactaaatacacaatggcagacctcgtctatgctttaaggcattttgatgaaggtaattgtgacacattaaaagaaatacttgtcacatacaattgttgtgatgatgattatttcaataaaaaggactggtatgattttgtagaaaacccagatatattacgcgtatacgccaacttaggtgaacgtgtacgccaagctttgttaaaaacagtacaattctgtgatgccatgcgaaatgctggtattgttggtgtactgacattagataatcaagatctcaatggtaactggtatgatttcggtgatttcatacaaaccacgccaggtagtggagttcctgttgtagattcttattattcattgttaatgcctatattaaccttgaccagggctttaactgcagagtcacatgttgacactgacttaacaaagccttacattaagtgggatttgttaaaatatgacttcacggaagagaggttaaaactctttgaccgttattttaaatattgggatcagacataccacccaaattgtgttaactgtttggatgacagatgcattctgcattgtgcaaactttaatgttttattctctacagtgttcccacctacaagttttggaccactagtgagaaaaatatttgttgatggtgttccatttgtagtttcaactggataccacttcagagagctaggtgttgtacataatcaggatgtaaacttacatagctctagacttagttttaaggaattacttgtgtatgctgctgaccctgctatgcacgctgcttctggtaatctattactagataaacgcactacgtgcttttcagtagctgcacttactaacaatgttgcttttcaaactgtcaaacccggtaattttaacaaagacttctatgactttgctgtgtctaagggtttctttaaggaaggaagttctgttgaattaaaacacttcttctttgctcaggatggtaatgctgctatcagcgattatgactactatcgttataatctaccaacaatgtgtgatatcagacaactactatttgtagttgaagttgttgataagtactttgattgttacgatggtggctgtattaatgctaaccaagtcatcgtcaacaacctagacaaatcagctggttttccatttaataaatggggtaaggctagactttattatgattcaatgagttatgaggatcaagatgcacttttcgcatatacaaaacgtaatgtcatccctactataactcaaatgaatcttaagtatgccattagtgcaaagaatagagctcgcaccgtagctggtgtctctatctgtagtactatgaccaatagacagtttcatcaaaaattattgaaatcaatagccgccactagaggagctactgtagtaattggaacaagcaaattctatggtggttggcacaacatgttaaaaactgtttatagtgatgtagaaaaccctcaccttatgggttgggattatcctaaatgtgatagagccatgcctaacatgcttagaattatggcctcacttgttcttgctcgcaaacatacaacgtgttgtagcttgtcacaccgtttctatagattagctaatgagtgtgctcaagtattgagtgaaatggtcatgtgtggcggttcactatatgttaaaccaggtggaacctcatcaggagatgccacaactgcttatgctaatagtgtttttaacatttgtcaagctgtcacggccaatgttaatgcacttttatctactgatggtaacaaaattgccgataagtatgtccgcaatttacaacacagactttatgagtgtctctatagaaatagagatgttgacacagactttgtgaatgagttttacgcatatttgcgtaaacatttctcaatgatgatactctctgacgatgctgttgtgtgtttcaatagcacttatgcatctcaaggtctagtggctagcataaagaactttaagtcagttctttattatcaaaacaatgtttttatgtctgaagcaaaatgttggactgagactgaccttactaaaggacctcatgaattttgctctcaacatacaatgctagttaaacagggtgatgattatgtgtaccttccttacccagatccatcaagaatcctaggggccggctgttttgtagatgatatcgtaaaaacagatggtacacttatgattgaacggttcgtgtctttagctatagatgcttacccacttactaaacatcctaatcaggagtatgctgatgtctttcatttgtacttacaatacataagaaagctacatgatgagttaacaggacacatgttagacatgtattctgttatgcttactaatgataacacttcaaggtattgggaacctgagttttatgaggctatgtacacaccgcatacagtcttacaggctgttggggcttgtgttctttgcaattcacagacttcattaagatgtggtgcttgcatacgtagaccattcttatgttgtaaatgctgttacgaccatgtcatatcaacatcacataaattagtcttgtctgttaatccgtatgtttgcaatgctccaggttgtgatgtcacagatgtgactcaactttacttaggaggtatgagctattattgtaaatcacataaaccacccattagttttccattgtgtgctaatggacaagtttttggtttatataaaaatacatgtgttggtagcgataatgttactgactttaatgcaattgcaacatgtgactggacaaatgctggtgattacattttagctaacacctgtactgaaagactcaagctttttgcagcagaaacgctcaaagctactgaggagacatttaaactgtcttatggtattgctactgtacgtgaagtgctgtctgacagagaattacatctttcatgggaagttggtaaacctagaccaccacttaaccgaaattatgtctttactggttatcgtgtaactaaaaacagtaaagtacaaataggagagtacacctttgaaaaaggtgactatggtgatgctgttgtttaccgaggtacaacaacttacaaattaaatgttggtgattattttgtgctgacatcacatacagtaatgccattaagtgcacctacactagtgccacaagagcactatgttagaattactggcttatacccaacactcaatatctcagatgagttttctagcaatgttgcaaattatcaaaaggttggtatgcaaaagtattctacactccagggaccacctggtactggtaagagtcattttgctattggcctagctctctactacccttctgctcgcatagtgtatacagcttgctctcatgccgctgttgatgcactatgtgagaaggcattaaaatatttgcctatagataaatgtagtagaattatacctgcacgtgctcgtgtagagtgttttgataaattcaaagtgaattcaacattagaacagtatgtcttttgtactgtaaatgcattgcctgagacgacagcagatatagttgtctttgatgaaatttcaatggccacaaattatgatttgagtgttgtcaatgccagattacgtgctaagcactatgtgtacattggcgaccctgctcaattacctgcaccacgcacattgctaactaagggcacactagaaccagaatatttcaattcagtgtgtagacttatgaaaactataggtccagacatgttcctcggaacttgtcggcgttgtcctgctgaaattgttgacactgtgagtgctttggtttatgataataagcttaaagcacataaagacaaatcagctcaatgctttaaaatgttttataagggtgttatcacgcatgatgtttcatctgcaattaacaggccacaaataggcgtggtaagagaattccttacacgtaaccctgcttggagaaaagctgtctttatttcaccttataattcacagaatgctgtagcctcaaagattttgggactaccaactcaaactgttgattcatcacagggctcagaatatgactatgtcatattcactcaaaccactgaaacagctcactcttgtaatgtaaacagatttaatgttgctattaccagagcaaaagtaggcatactttgcataatgtctgatagagacctttatgacaagttgcaatttacaagtcttgaaattccacgtaggaatgtggcaactttacaagctgaaaatgtaacaggactttttaaagattgtagtaaggtaatcactgggttacatcctacacaggcacctacacacctcagtgttgacactaaattcaaaactgaaggtttatgtgttgacatacctggcatacctaaggacatgacctatagaagactcatctctatgatgggttttaaaatgaattatcaagttaatggttaccctaacatgtttatcacccgcgaagaagctataagacatgtacgtgcatggattggcttcgatgtcgaggggtgtcatgctactagagaagctgttggtaccaatttacctttacagctaggtttttctacaggtgttaacctagttgctgtacctacaggttatgttgatacacctaataatacagatttttccagagttagtgctaaaccaccgcctggagatcaatttaaacacctcataccacttatgtacaaaggacttccttggaatgtagtgcgtataaagattgtacaaatgttaagtgacacacttaaaaatctctctgacagagtcgtatttgtcttatgggcacatggctttgagttgacatctatgaagtattttgtgaaaataggacctgagcgcacctgttgtctatgtgatagacgtgccacatgcttttccactgcttcagacacttatgcctgttggcatcattctattggatttgattacgtctataatccgtttatgattgatgttcaacaatggggttttacaggtaacctacaaagcaaccatgatctgtattgtcaagtccatggtaatgcacatgtagctagttgtgatgcaatcatgactaggtgtctagctgtccacgagtgctttgttaagcgtgttgactggactattgaatatcctataattggtgatgaactgaagattaatgcggcttgtagaaaggttcaacacatggttgttaaagctgcattattagcagacaaattcccagttcttcacgacattggtaaccctaaagctattaagtgtgtacctcaagctgatgtagaatggaagttctatgatgcacagccttgtagtgacaaagcttataaaatagaagaattattctattcttatgccacacattctgacaaattcacagatggtgtatgcctattttggaattgcaatgtcgatagatatcctgctaattccattgtttgtagatttgacactagagtgctatctaaccttaacttgcctggttgtgatggtggcagtttgtatgtaaataaacatgcattccacacaccagcttttgataaaagtgcttttgttaatttaaaacaattaccatttttctattactctgacagtccatgtgagtctcatggaaaacaagtagtgtcagatatagattatgtaccactaaagtctgctacgtgtataacacgttgcaatttaggtggtgctgtctgtagacatcatgctaatgagtacagattgtatctcgatgcttataacatgatgatctcagctggctttagcttgtgggtttacaaacaatttgatacttataacctctggaacacttttacaagacttcagagtttagaaaatgtggcttttaatgttgtaaataagggacactttgatggacaacagggtgaagtaccagtttctatcattaataacactgtttacacaaaagttgatggtgttgatgtagaattgtttgaaaataaaacaacattacctgttaatgtagcatttgagctttgggctaagcgcaacattaaaccagtaccagaggtgaaaatactcaataatttgggtgtggacattgctgctaatactgtgatctgggactacaaaagagatgctccagcacatatatctactattggtgtttgttctatgactgacatagccaagaaaccaactgaaacgatttgtgcaccactcactgtcttttttgatggtagagttgatggtcaagtagacttatttagaaatgcccgtaatggtgttcttattacagaaggtagtgttaaaggtttacaaccatctgtaggtcccaaacaagctagtcttaatggagtcacattaattggagaagccgtaaaaacacagttcaattattataagaaagttgatggtgttgtccaacaattacctgaaacttactttactcagagtagaaatttacaagaatttaaacccaggagtcaaatggaaattgatttcttagaattagctatggatgaattcattgaacggtataaattagaaggctatgccttcgaacatatcgtttatggagattttagtcatagtcagttaggtggtttacatctactgattggactagctaaacgttttaaggaatcaccttttgaattagaagattttattcctatggacagtacagttaaaaactatttcataacagatgcgcaaacaggttcatctaagtgtgtgtgttctgttattgatttattacttgatgattttgttgaaataataaaatcccaagatttatctgtagtttctaaggttgtcaaagtgactattgactatacagaaatttcatttatgctttggtgtaaagatggccatgtagaaacattttacccaaaattacaatctagtcaagcgtggcaaccgggtgttgctatgcctaatctttacaaaatgcaaagaatgctattagaaaagtgtgaccttcaaaattatggtgatagtgcaacattacctaaaggcataatgatgaatgtcgcaaaatatactcaactgtgtcaatatttaaacacattaacattagctgtaccctataatatgagagttatacattttggtgctggttctgataaaggagttgcaccaggtacagctgttttaagacagtggttgcctacgggtacgctgcttgtcgattcagatcttaatgactttgtctctgatgcagattcaactttgattggtgattgtgcaactgtacatacagctaataaatgggatctcattattagtgatatgtacgaccctaagactaaaaatgttacaaaagaaaatgactctaaagagggttttttcacttacatttgtgggtttatacaacaaaagctagctcttggaggttccgtggctataaagataacagaacattcttggaatgctgatctttataagctcatgggacacttcgcatggtggacagcctttgttactaatgtgaatgcgtcatcatctgaagcatttttaattggatgtaattatcttggcaaaccacgcgaacaaatagatggttatgtcatgcatgcaaattacatattttggaggaatacaaatccaattcagttgtcttcctattctttatttgacatgagtaaatttccccttaaattaaggggtactgctgttatgtctttaaaagaaggtcaaatcaatgatatgattttatctcttcttagtaaaggtagacttataattagagaaaacaacagagttgttatttctagtgatgttcttgttaacaactaaacgaacaatgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaacgaacttatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgtaagcacaagctgatgagtacgaacttatgtactcattcgtttcggaagagacaggtacgttaatagttaatagcgtacttctttttcttgctttcgtggtattcttgctagttacactagccatccttactgcgcttcgattgtgtgcgtactgctgcaatattgttaacgtgagtcttgtaaaaccttctttttacgtttactctcgtgttaaaaatctgaattcttctagagttcctgatcttctggtctaaacgaactaaatattatattagtttttctgtttggaactttaattttagccatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagtaagtgacaacagatgtttcatctcgttgactttcaggttactatagcagagatattactaattattatgaggacttttaaagtttccatttggaatcttgattacatcataaacctcataattaaaaatttatctaagtcactaactgagaataaatattctcaattagatgaagagcaaccaatggagattgattaaacgaacatgaaaattattcttttcttggcactgataacactcgctacttgtgagctttatcactaccaagagtgtgttagaggtacaacagtacttttaaaagaaccttgctcttctggaacatacgagggcaattcaccatttcatcctctagctgataacaaatttgcactgacttgctttagcactcaatttgcttttgcttgtcctgacggcgtaaaacacgtctatcagttacgtgccagatcagtttcacctaaactgttcatcagacaagaggaagttcaagaactttactctccaatttttcttattgttgcggcaatagtgtttataacactttgcttcacactcaaaagaaagacagaatgattgaactttcattaattgacttctatttgtgctttttagcctttctgctattccttgttttaattatgcttattatcttttggttctcacttgaactgcaagatcataatgaaacttgtcacgcctaaacgaacatgaaatttcttgttttcttaggaatcatcacaactgtagctgcatttcaccaagaatgtagtttacagtcatgtactcaacatcaaccatatgtagttgatgacccgtgtcctattcacttctattctaaatggtatattagagtaggagctagaaaatcagcacctttaattgaattgtgcgtggatgaggctggttctaaatcacccattcagtacatcgatatcggtaattatacagtttcctgttcaccttttacaattaattgccaggaacctaaattgggtagtcttgtagtgcgttgttcgttctatgaagactttttagagtatcatgacgttcgtgttgttttagatttcatctaaacgaacaaactaaaatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaactcatgcagaccacacaaggcagatgggctatataaacgttttcgcttttccgtttacgatatatagtctactcttgtgcagaatgaattctcgtaactacatagcacaagtagatgtagttaactttaatctcacatagcaatctttaatcagtgtgtaacattagggaggacttgaaagagccaccacattttcaccgaggccacgcggagtacgatcgagtgtacagtgaacaatgctagggagagctgcctatatggaagagccctaatgtgtaaaattaattttagtagtgctatccccatgtgattttaatagcttcttaggagaatgacaaaaaaaaaaaa

SEQ ID NO: 24 - DNA, 25 bp, SARS-CoV-2
gtcacgcctaaacgaacatgaaatt

What is claimed is:

1. A vaccine composition comprising an inactivated Severe Acute Respiratory Syndrome Coronavirus 2 (SARS-CoV-2) viral particle, wherein the composition comprises at least 100 picograms or more of SARS-CoV-2 spike protein, an adjuvant capable of promoting a Th1-type immune response, and a pharmaceutically acceptable carrier or excipient, wherein the SARS-CoV-2 viral particle is inactivated by exposure to a dose of UV light in the presence of exogenous riboflavin in a buffered solution, and wherein the dose of UV light is from 0.5 Joules/mL to 3.0 Joules/mL of the vaccine composition.

2. The vaccine composition of claim 1, wherein the adjuvant is selected from: adjuvant system 1 (AS01), AS02, a phosphorothioate oligonucleotide having about 15 to 30 nucleotides, CpG oligodeoxynucleotide 1668 (ODN 1668), CpG 1018, monophosphoryl Lipid A (MPL), Polyinosinic: polycytidylic acid (Poly IC), Imiquimod, saponin fraction from *Quillaja saponaria*, immunostimulating complex matrices, cationic liposome-DNA complexes (CLDC), TLR5 agonist, Complete Freund's Adjuvant (CFA), TLR4 agonist, CpG with alum, delta insulin, a nucleic acid that comprises the sequence SEQ ID NO: 22, and nucleic acid that comprises the sequence SEQ ID NO: 21.

3. The vaccine composition of claim 2, wherein the adjuvant CpG 1018 comprises a nucleic acid that comprises the sequence SEQ ID NO: 21.

4. The vaccine composition of claim 2, wherein the adjuvant ODN 1668 comprises a nucleic acid that comprises the sequence SEQ ID NO: 22.

acid that comprises the sequence SEQ ID NO: 22, and nucleic acid that comprises the sequence SEQ ID NO: 21.

9. A vaccine composition comprising inactivated Severe Acute Respiratory Syndrome Coronavirus 2 (SARS-CoV-2) viral particle; wherein the composition comprises between 1 and 15 nanograms of SARS-CoV-2 spike protein; a phosphorothioate oligonucleotide adjuvant capable of promoting a Th1-type immune response; and a pharmaceutically acceptable carrier or excipient; wherein the SARS-CoV-2 genome comprises about 1 to about 30 oxidized guanine residues, the residues being oxidized by exposure to a dose of UV light in the presence of exogenous riboflavin in a buffered solution; wherein the structure of antigens on the viral particle is not substantially altered compared to SARS-CoV-2 viral particle that has not been inactivated, and wherein the dose of UV light is from 0.5 Joules/mL to 3.0 Joules/mL of the vaccine composition.

10. The vaccine composition of claim 9, wherein the SARS-CoV-2 genome comprises about 20 oxidized guanine residues caused by the dose of UV light in the presence of the exogenous riboflavin.

11. The vaccine composition of claim 9, wherein the adjuvant is a phosphorothioate oligonucleotide comprising about 15 to about 30 nucleotides.

12. The vaccine composition of claim 11, wherein the phosphorothioate oligonucleotide adjuvant is selected from ODN 1668, CpG 1018, a nucleic acid that comprises the sequence SEQ ID NO: 22, and nucleic acid that comprises the sequence SEQ ID NO: 21.

* * * * *